US012648958B2

(12) United States Patent
Anastassiadis et al.

(10) Patent No.: US 12,648,958 B2
(45) **Date of Patent: *Jun. 9, 2026**

(54) TREM COMPOSITIONS AND USES THEREOF

(71) Applicant: Flagship Pioneering Innovations VI, LLC, Cambridge, MA (US)

(72) Inventors: Theonie Anastassiadis, Somerville, MA (US); David Charles Donnell Butler, Medford, MA (US); Neil Kubica, Swampscott, MA (US); Qingyi Li, Somerville, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/820,096

(22) Filed: Aug. 29, 2024

(65) Prior Publication Data

US 2025/0000890 A1     Jan. 2, 2025

Related U.S. Application Data

(63) Continuation of application No. 17/519,120, filed on Nov. 4, 2021, now Pat. No. 12,121,531, which is a continuation of application No. PCT/US2021/027357, filed on Apr. 14, 2021.

(60) Provisional application No. 63/009,669, filed on Apr. 14, 2020.

(51) Int. Cl.
| | |
|---|---|
| *A61K 31/7088* | (2006.01) |
| *A61K 31/712* | (2006.01) |
| *A61K 31/7125* | (2006.01) |
| *C12N 15/11* | (2006.01) |
| *C12N 15/67* | (2006.01) |

(52) U.S. Cl.
CPC ........ *A61K 31/7088* (2013.01); *A61K 31/712* (2013.01); *A61K 31/7125* (2013.01); *C12N 15/11* (2013.01); *C12N 15/67* (2013.01); *C12N 2310/313* (2013.01); *C12N 2310/321* (2013.01); *C12N 2310/322* (2013.01)

(58) Field of Classification Search
CPC .............. A61K 31/7088; A61K 31/712; A61K 31/7125; C12N 15/11; C12N 15/67; C12N 2310/321; C12N 2310/322; C12N 2310/315; C12N 2310/3525; C12N 2310/3521; C12N 2310/3531; C12N 2310/3533
See application file for complete search history.

(56) References Cited

U.S. PATENT DOCUMENTS

| | | | |
|---|---|---|---|
| 6,969,763 | B1 | 11/2005 | Ecker et al. |
| 10,337,065 | B2 | 7/2019 | Tavazoie et al. |
| 12,121,531 | B2 * | 10/2024 | Anastassiadis ........ C12N 15/11 |
| 2008/0213377 | A1 * | 9/2008 | Bhatia ...................... B82Y 5/00 |
| | | | 530/300 |
| 2013/0267694 | A1 | 10/2013 | Xu et al. |
| 2013/0267695 | A1 | 10/2013 | Webb et al. |
| 2017/0369871 | A1 | 12/2017 | Ptacin et al. |

FOREIGN PATENT DOCUMENTS

| | | |
|---|---|---|
| WO | 1999/036519 A1 | 7/1999 |
| WO | 2000/027340 A2 | 5/2000 |
| WO | 2003/091268 A1 | 11/2003 |
| WO | 2007/144508 A2 | 12/2007 |
| WO | 2008/014979 A2 | 2/2008 |
| WO | 2008/083949 A2 | 7/2008 |
| WO | 2012/006551 A2 | 1/2012 |
| WO | 2017/085718 A1 | 5/2017 |
| WO | 2017121988 A1 | 7/2017 |
| WO | 2018/161032 A1 | 9/2018 |
| WO | 2019/090154 A1 | 5/2019 |
| WO | 2019/090169 A1 | 5/2019 |
| WO | 2019/175316 A1 | 9/2019 |
| WO | 2019/204733 A1 | 10/2019 |
| WO | 2019/226603 | 11/2019 |
| WO | 2020/069194 A1 | 4/2020 |
| WO | 2020/150608 A1 | 7/2020 |
| WO | 2020/208169 A1 | 10/2020 |
| WO | 2020/247803 A2 | 12/2020 |
| WO | 2021/035391 A1 | 3/2021 |
| WO | 2021/087401 A1 | 5/2021 |
| WO | 2021/113218 A1 | 6/2021 |
| WO | 2021/142343 A1 | 7/2021 |
| WO | 2021/211762 A2 | 10/2021 |

OTHER PUBLICATIONS

Megel et al., Surveillance and Cleavage of Eukaryotic tRNAs, 2015, Int. J. Mol. Sci., 16, 1873-1893. (Year: 2015).*

Lorenz et al., tRNA Modifications: Impact on Structure and Thermal Adaptation, 2017, Biomolecules, 7, p. 1-29. (Year: 2017).*

Crooke et al, RNA-Targeted Therapeutics, 2018, Cell Metabolism, 27, 714-739 (Year: 2018).*

Modified Bases Modifications. Integrated DNA Technologies, 2019 [online]. [Retrieved on Jul. 9, 2021]. Retrieved from the Internet URL: https://web.archive.org/web/20190904151113/https://www.idtdna.com/site/Catalog/Modifications/Category/7.

Endres et al., "2'-O-ribose methylation of transfer RNA promotes recovery from oxidative stress in *Saccharomyces cerevisiae*" PLoS ONE, 2020, vol. 15, No. 2.

International Search Report and Written Opinion for Application No. PCT/US2021/027357 mailed Oct. 4, 2021.

Sako et al., "A novel therapeutic approach for genetic diseases by introduction of suppressor tRNAs", Nucleic Acid Symp Ser, 2006, No. 50, pp. 239-240.

Pavon-Eternod et al., "Overexpression of initiator methionine tRNA leads to global reprograming of tRNA expression and increased proliferation in human epithelial cells", RNA, 2013, vol. 19, pp. 461-466.

(Continued)

*Primary Examiner* — Jennifer Dunston
*Assistant Examiner* — Keyur A Vyas
(74) *Attorney, Agent, or Firm* — Lando & Anastasi, LLP

(57) ABSTRACT

The invention relates generally to tRNA-based effector molecules having a non-naturally occurring modification and methods relating thereto.

14 Claims, 1 Drawing Sheet

Specification includes a Sequence Listing.

(56)                    References Cited

OTHER PUBLICATIONS

Kirchner et al., "Alteration of protein function by a silent polymorphism linked to tRNA abundance" PLOS Biol, 2017, vol. 15, No. 5.

Lueck et al., "Engineered transfer RNAs for suppression of premature termination codons", Nat Comm , 2019, vol. 10.

Integrated DNA Technologies, ITDN, https://www.idtdna. corn/site/catalog/modifications/category/7. (Year: 2019).

Dabrowski et al., "Interaction of tRNAs with the ribosome at the A and P sites" The EMBO Journal, 1995, vol. 14, No. 19, pp. 4872-4882.

Lin et al., "tRNAviz: explore and visualize tRNA sequence features" Nucleic Acids Research, 2019, vol. 47, Webserver Issue, W542-W547.

Pak et al., "tRNA structure and evolution and standardization to the three nucleotide genetic code" Transcription, 2017, vol. 8, No. 4, 205-219.

Sprinzl et al., "Compilation of tRNA Sequences" Nucleic Acids Research, 1978, r15-r27.

Jason S. Feinberg: "Identification of molecular interactions between P-site tRNA and the ribosome essential for translocation" , Proceedings of the National Academy of Sciences, vol. 98, No. 20, Sep. 25, 2001 (Sep. 25, 2001), pp. 11120-11125, XP093156172, ISSN: 0027-8424, DOI: 10.1073/pnas.211184098.

Y.-M. Hou: "An important 2'-OH group for 1-4,7 an RNA-protein interaction", Nucleic Acids Research, vol. 29, No. 4, Feb. 15, 2001 (Feb. 15, 2001), pp. 976-985, XP093156187, GB ISSN: 1362-4962, DOI: 10.1093/nar/29.4.976.

Valerie De Crecy-Lagard: "Matching tRNA 1 modifications in humans to their known and predicted enzymes" , Nucleic Acids Research, vol. 47, No. 5, Jan. 30, 2019 (Jan. 30, 2019), pp. 2143-2159, XP093156180, GB ISSN: 0305-1048, DOI: 10.1093/nar/gkzoll.

Feinberg et al., "Identification of molecular interactions between P-site tRNA and the ribosome essential for translocation" PNAS, 2001, vol. 98, No. 20, pp. 11120-11125.

* cited by examiner

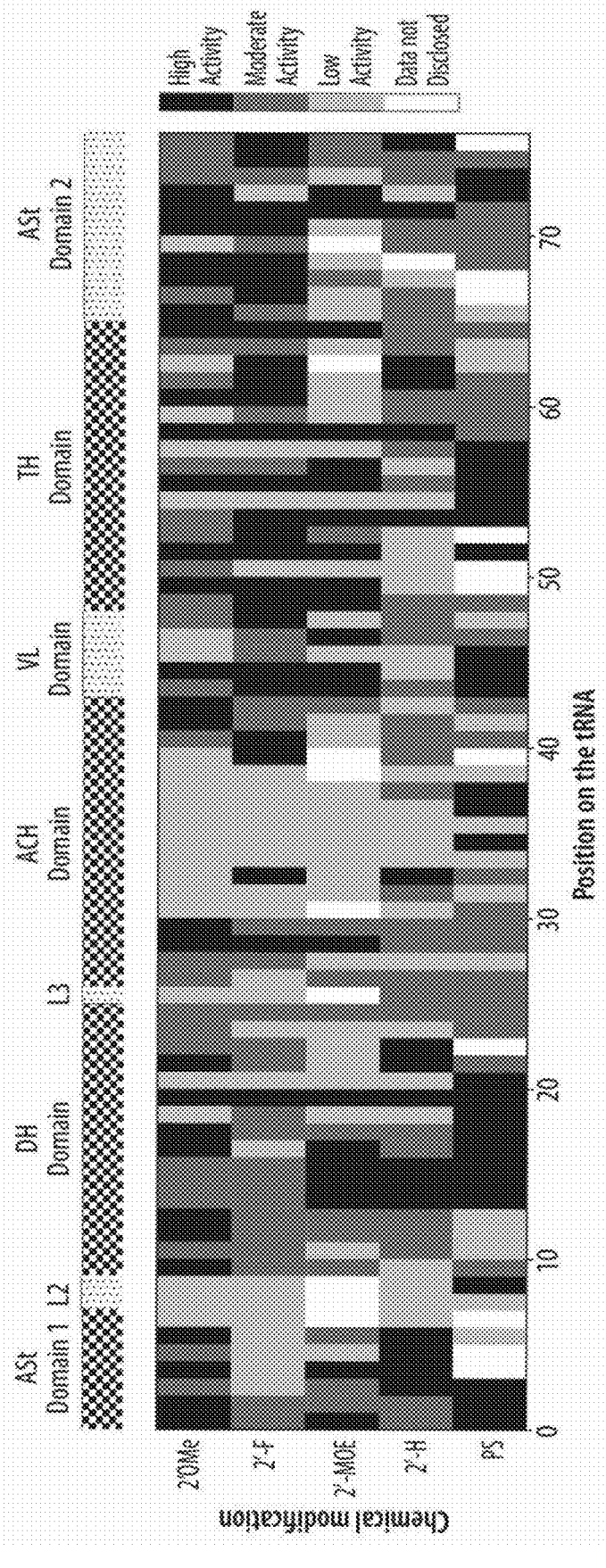

TREM COMPOSITIONS AND USES THEREOF

CROSS-REFERENCE TO RELATED APPLICATIONS

This application is a is a continuation of U.S. Utility application Ser. No. 17/519,120, filed Nov. 4, 2021, which is a continuation of International Application No. PCT/US2021/027357, filed Apr. 14, 2021, which claims priority to U.S. Provisional Application No. 63/009,669, filed on Apr. 14, 2020, the entire contents of which is hereby incorporated by reference.

SEQUENCE LISTING

The instant application contains a Sequence Listing which has been submitted electronically in ASCII format and is hereby incorporated by reference in its entirety. Said ASCII copy, created on May 25, 2021, is named F2099-7004WO (VL63009-W1)_SL.txt and is 435,100 bytes in size.

BACKGROUND

Transfer RNAs (tRNAs) are complex, naturally occurring RNA molecules that possess a number of functions including initiation and elongation of proteins.

SUMMARY

The present disclosure features modified tRNA-based effector molecules (TREMs, e.g., a TREM or TREM fragment), as well as related compositions and uses thereof. As provided herein, TREMs are complex molecules which can mediate a variety of cellular processes. The TREMs disclosed herein comprise at least one modification (e.g., a non-naturally occurring modification), e.g., on a component nucleotide (e.g., a nucleobase or sugar) or within an internucleotide region, e.g., the TREM backbone. In one aspect, provided herein is a TREM comprising a sequence of Formula A: [L1]-[ASt Domain1]-[L2]-[DH Domain]-[L3]-[ACH Domain]-[VL Domain]-[TH Domain]-[L4]-[ASt Domain2], wherein independently, [L1] and [VL Domain], are optional; and one of [L1], [ASt Domain1], [L2]-[DH Domain], [L3], [ACH Domain], [VL Domain], [TH Domain], [L4], and [ASt Domain2] comprises a nucleotide comprising a non-naturally occurring modification.

In an embodiment, the TREM: (a) has the ability to: (i) support protein synthesis, (ii) be charged by a synthetase, (iii) be bound by an elongation factor, (iv) introduce an amino acid into a peptide chain, (v) support elongation, or (vi) support initiation; (b) comprises at least X contiguous nucleotides without a non-naturally occurring modification, wherein X is greater than 3, 4, 5, 6, 7, 8, 9, or 10; (c) comprises at least 3, but less than all of the nucleotides of a type (e.g., A, T, C, G or U) comprise the same non-naturally occurring modification; (d) comprises at least X nucleotides of a type (e.g., A, T, C, G or U) that do not comprise a non-naturally occurring modification, wherein x=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50; (e) comprises no more than 5, 10, or 15 nucleotides of a type (e.g., A, T, C, G or U) that comprise a non-naturally occurring modification; and/or (f) comprises no more than 5, 10, or 15 nucleotides of a type (e.g., A, T, C, G or U) that do not comprise a non-naturally occurring modification.

In an embodiment, the TREM comprises feature (a) (i). In an embodiment, the TREM comprises feature (a) (ii). In an embodiment, the TREM comprises feature (a) (iii). In an embodiment, the TREM comprises feature (a) (iv). In an embodiment, the TREM comprises feature (a) (v). In an embodiment, the TREM comprises feature (a) (vi). In an embodiment, the TREM comprises feature (b). In an embodiment, the TREM comprises feature (c). In an embodiment, the TREM comprises feature (d). In an embodiment, the TREM comprises feature (e). In an embodiment, the TREM comprises feature (f). In an embodiment, the TREM comprises all of features (a)-(f) or a combination thereof.

In an embodiment, the TREM Domain comprising the non-naturally occurring modification has a function, e.g., a domain function described herein.

In an aspect, provided herein is a TREM core fragment comprising a sequence of Formula B:

$$[L1]_y\text{-}[ASt\ Domain1]_x\text{-}[L2]_y\text{-}[DH\ Domain]_y\text{-}[L3]_y\text{-}$$
$$[ACH\ Domain]_x\text{-}[VL\ Domain]_y\text{-}[TH\ Domain]_y\text{-}$$
$$[L4]_y\text{-}[ASt\ Domain2]_x,$$

wherein x=1 and y=0 or 1; and one of [ASt Domain1], [ACH Domain], and [ASt Domain2] comprises a nucleotide having a non-naturally occurring modification.

In an embodiment, the TREM has the ability to support protein synthesis. In an embodiment, the TREM has the ability to be able to be charged by a synthetase. In an embodiment, the TREM has the ability to be bound by an elongation factor. In an embodiment, the TREM has the ability to introduce an amino acid into a peptide chain. In an embodiment, the TREM has the ability to support elongation. In an embodiment, the TREM has the ability to support initiation.

In an embodiment, the [ASt Domain 1] and/or [ASt Domain 2] comprising the non-naturally occurring modification has the ability to initiate or elongate a polypeptide chain.

In an embodiment, the [ACH Domain] comprising the non-naturally occurring modification has the ability to mediate pairing with a codon.

In an embodiment, y=1 for any one, two, three, four, five, six, all or a combination of [L1], [L2], [DH Domain], [L3], [VL Domain], [TH Domain], [L4].

In an embodiment, y=0 for any one, two, three, four, five, six, all or a combination of [L1], [L2], [DH Domain], [L3], [VL Domain], [TH Domain], [L4].

In an embodiment, y=1 for linker [L1], and L1 comprises a nucleotide having a non-naturally occurring modification.

In an embodiment, y=1 for linker [L2], and L2 comprises a nucleotide having a non-naturally occurring modification.

In an embodiment, y=1 for [DH Domain (DHD)], and DHD comprises a nucleotide having a non-naturally occurring modification. In an embodiment, the DHD comprising the non-naturally occurring modification has the ability to mediate recognition of aminoacyl-tRNA synthetase.

In an embodiment, y=1 for linker [L3], and L3 comprises a nucleotide having a non-naturally occurring modification.

In an embodiment, y=1 for [VL Domain (VLD)], and VLD comprises a nucleotide having a non-naturally occurring modification.

In an embodiment, y=1 for [TH Domain (THD)], and THD comprises a nucleotide having a non-naturally occurring modification. In an embodiment, the THD comprising the non-naturally occurring modification has the ability to mediate recognition of the ribosome.

In an embodiment, y=1 for linker [L4], and L4 comprises a nucleotide having a non-naturally occurring modification.

In another aspect, the disclosure provides a TREM fragment comprising a portion of a TREM, wherein the TREM comprises a sequence of Formula A:

[L1]-[ASt Domain1]-[L2]-[DH Domain]-[L3]-[ACH Domain]-[VL Domain]-[TH Domain]-[LA]-[ASt Domain2], and wherein the TREM fragment comprises a non-naturally occurring modification.

In an embodiment, the TREM fragment comprises one, two, three or all or any combination of the following: (a) a TREM half (e.g., from a cleavage in the ACH Domain, e.g., in the anticodon sequence, e.g., a 5'half or a 3' half); (b) a 5' fragment (e.g., a fragment comprising the 5' end, e.g., from a cleavage in a DH Domain or the ACH Domain); (c) a 3' fragment (e.g., a fragment comprising the 3' end, e.g., from a cleavage in the TH Domain); or (d) an internal fragment (e.g., from a cleavage in any one of the ACH Domain, DH Domain or TH Domain).

In an embodiment, the TREM fragment comprise (a) a TREM half which comprises a nucleotide having a non-naturally occurring modification.

In an embodiment, the TREM fragment comprise (b) a 5' fragment which comprises a nucleotide having a non-naturally occurring modification.

In an embodiment, the TREM fragment comprise (c) a 3' fragment which comprises a nucleotide having a non-naturally occurring modification.

In an embodiment, the TREM fragment comprise (d) an internal fragment which comprises a nucleotide having a non-naturally occurring modification.

In an embodiment of any of the TREMs, TREM core fragments, or TREM fragments disclosed herein, the TREM Domain comprises a plurality of nucleotides each having a non-naturally occurring modification. In an embodiment, the non-naturally occurring modification comprises a nucleobase modification, a sugar (e.g., ribose) modification, or a backbone modification. In an embodiment, the non-naturally occurring modification is a sugar (e.g., ribose) modification. In an embodiment, the non-naturally occurring modification is 2'-ribose modification, e.g., a 2'-OMe, 2'-halo (e.g., 2'-F), 2'-MOE, or 2'-deoxy modification. In an embodiment, the non-naturally occurring modification is a backbone modification, e.g., a phosphorothioate modification.

In an embodiment of any of the TREMs, TREM core fragments, or TREM fragments disclosed herein, the TREM sequence comprises a CCA sequence on a terminus, e.g., the 3' terminus. In an embodiment, the TREM sequence does not comprise a CCA sequence on a terminus, e.g., the 3' terminus.

In an embodiment of any of the TREMs, TREM core fragments, or TREM fragments disclosed herein, the non-naturally occurring modification is a modification in a base or a backbone of a nucleotide, e.g., a modification chosen from any one of Tables 5, 6, 7, 8 or 9.

In an embodiment of any of the TREMs, TREM core fragments, or TREM fragments disclosed herein, the non-naturally occurring modification is a base modification chosen from a modification listed in Table 5.

In an embodiment of any of the TREMs, TREM core fragments, or TREM fragments disclosed herein, the non-naturally occurring modification is a base modification chosen from a modification listed in Table 6.

In an embodiment of any of the TREMs, TREM core fragments, or TREM fragments disclosed herein, the non-naturally occurring modification is a base modification chosen from a modification listed in Table 7.

In an embodiment of any of the TREMs, TREM core fragments, or TREM fragments disclosed herein, the non-naturally occurring modification is a backbone modification chosen from a modification listed in Table 8.

In an embodiment of any of the TREMs, TREM core fragments, or TREM fragments disclosed herein, the non-naturally occurring modification is a backbone modification chosen from a modification listed in Table 9.

In an embodiment of any of the TREMs, TREM core fragments, or TREM fragments disclosed herein, the TREM, TREM core fragment, or TREM fragment is encoded by a sequence provided in Table 1, e.g., any one of SEQ ID NOs 1-451.

In an embodiment of any of the TREMs, TREM core fragments, or TREM fragments disclosed herein, the TREM, TREM core fragment, or TREM fragment is encoded by a consensus sequence chosen from any one of SEQ ID NOs: 562-621.

In an embodiment of any of the TREMs, TREM core fragments, or TREM fragments disclosed herein, the TREM, TREM core fragment, or TREM fragment is encoded by a sequence provided in any one of Tables 15-22, e.g., any one of SEQ ID NOs: 622-1187. In an embodiment, the TREM, TREM core fragment, or TREM fragment is encoded by a sequence provided in Table 15, e.g., any one of SEQ ID NOs: 622-698. In an embodiment, the TREM, TREM core fragment, or TREM fragment is encoded by a sequence provided in Table 16, e.g., any one of SEQ ID NOs: 699-774. In an embodiment, the TREM, TREM core fragment, or TREM fragment is encoded by a sequence provided in Table 17, e.g., any one of SEQ ID NOs: 775-841. In an embodiment, the TREM, TREM core fragment, or TREM fragment is encoded by a sequence provided in Table 18, e.g., any one of SEQ ID NOs: 842-917. In an embodiment; the TREM, TREM core fragment, or TREM fragment is encoded by a sequence provided in Table 19, e.g., any one of SEQ ID NOs: 918-992. In an embodiment, the TREM, TREM core fragment, or TREM fragment is encoded by a sequence provided in Table 20, e.g., any one of SEQ ID NOs: 993-1078. In an embodiment, the TREM, TREM core fragment, or TREM fragment is encoded by a sequence provided in Table 21, e.g., any one of SEQ ID NOs: 1079-1154. In an embodiment, the TREM, TREM core fragment, or TREM fragment is encoded by a sequence provided in Table 22, e.g., any one of SEQ ID NOs: 1155-1187.

In another aspect, the disclosure provides a pharmaceutical composition comprising a TREM, a TREM core fragment, or a TREM fragment disclosed herein.

In another aspect, the disclosure provides a method of making a TREM, a TREM core fragment, or a TREM fragment disclosed herein, comprising linking a first nucleotide to a second nucleotide to form the TREM.

In an embodiment, the TREM, TREM core fragment or TREM fragment is non-naturally occurring (e.g., synthetic).

In an embodiment, the TREM, TREM core fragment or TREM fragment is made by cell-free solid phase synthesis.

In another aspect, the disclosure provides a method of modulating a tRNA pool in a cell comprising: providing a TREM, a TREM core fragment, or a TREM fragment disclosed herein, and contacting the cell with the TREM, TREM core fragment or TREM fragment, thereby modulating the tRNA pool in the cell.

In an aspect, the disclosure provides a method of contacting a cell, tissue, or subject with a TREM, a TREM core fragment, or a TREM fragment disclosed herein, comprising: contacting the cell, tissue or subject with the TREM, TREM core fragment or TREM fragment, thereby contacting the cell, tissue, or subject with the TREM, TREM core fragment or TREM fragment.

In another aspect, the disclosure provides a method of delivering a TREM, TREM core fragment or TREM fragment to a cell, tissue, or subject, comprising: providing a cell, tissue, or subject, and contacting the cell, tissue, or subject, a TREM, a TREM core fragment, or a TREM fragment disclosed herein.

In an aspect, the disclosure provides a method of modulating a tRNA pool in a cell comprising an endogenous open reading frame (ORF), which ORF comprises a codon having a first sequence, comprising:

optionally, acquiring knowledge of the abundance of one or both of (i) and (ii), e.g., acquiring knowledge of the relative amounts of: (i) and (ii) in the cell, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the cell; contacting the cell with a TREM, a TREM core fragment, or a TREM fragment disclosed herein, wherein the TREM, TREM core fragment or TREM fragment has an anticodon that pairs with: the codon having the first sequence; or the codon other than the codon having the first sequence, in an amount and/or for a time sufficient to modulate the relative amounts of the first tRNA moiety and the second tRNA moiety in the cell, thereby modulating the tRNA pool in the cell.

In another aspect, the disclosure provides a method of modulating a tRNA pool in a subject having an ORF, which ORF comprises a codon having a first sequence, comprising: optionally, acquiring knowledge of the abundance of one or both of (i) and (ii), e.g., acquiring knowledge of the relative amounts of: (i) and (ii) in the subject, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the subject;

contacting the subject with a TREM, a TREM core fragment, or a TREM fragment disclosed herein, wherein the TREM, TREM core fragment or TREM fragment has an anticodon that pairs with: the codon having the first sequence; or the codon other than the codon having the first sequence, in an amount and/or for a time sufficient to modulate the relative amounts of the first tRNA moiety and the second tRNA moiety in the subject, thereby modulating the tRNA pool in the subject.

In an aspect, the disclosure provides a method of modulating a tRNA pool in a subject having an endogenous ORF comprising a codon comprising a synonymous mutation (a synonymous mutation codon or SMC), comprising:

providing a composition comprising a TREM, a TREM core fragment, or a TREM fragment disclosed herein, wherein the TREM, TREM core fragment or TREM fragment comprises an isoacceptor tRNA moiety comprising an anticodon sequence that pairs with the SMC (the TREM);

contacting the subject with the composition in an amount and/or for a time sufficient to modulate the tRNA pool in the subject, thereby modulating the tRNA pool in the subject.

In another aspect, the disclosure provides a method of modulating a tRNA pool in a cell comprising an endogenous ORF comprising a codon comprising a SMC, comprising:

providing a composition comprising a TREM, a TREM core fragment, or a TREM fragment disclosed herein, wherein the TREM, TREM core fragment or TREM fragment comprises an isoacceptor tRNA moiety comprising an anticodon sequence that pairs with the SMC (the TREM);

contacting the cell with the composition comprising a TREM in an amount and/or for a time sufficient to modulate the tRNA pool in the cell, thereby modulating the tRNA pool in the cell.

In an aspect, the disclosure provides a method of modulating expression of a protein in a cell, wherein the protein is encoded by a nucleic acid comprising an ORF, which ORF comprises a codon having a mutation, comprising:

contacting the cell with a composition comprising a TREM, a TREM core fragment, or a TREM fragment disclosed herein in an amount and/or for a time sufficient to modulate expression of the encoded protein, wherein the TREM, TREM core fragment or TREM fragment has an anticodon that pairs with the codon having the mutation, thereby modulating expression of the protein in the cell.

In another aspect, the disclosure provides a method of modulating expression of a protein in a subject, wherein the protein is encoded by a nucleic acid comprising an endogenous ORF, which ORF comprises a codon having a mutation, comprising:

contacting the subject with a composition comprising a TREM, a TREM core fragment, or a TREM fragment disclosed herein, in an amount and/or for a time sufficient to modulate expression of the encoded protein, wherein the TREM, TREM core fragment or TREM fragment has an anticodon that pairs with the codon having the mutation, thereby modulating expression of the protein in the subject.

In an embodiment of any of the methods disclosed herein, the mutation in the ORF is a nonsense mutation, e.g., resulting in a premature stop codon chosen from UAA, UGA or UAG. In an embodiment, the stop codon is UAA. In an embodiment, the stop codon is UGA. In an embodiment, the stop codon is UAG.

In an embodiment of any of the methods disclosed herein, the TREM comprises an anticodon that pairs with a stop codon.

TREMs of the disclosure include TREMs, TREM core fragments and TREM fragments. TREMs, TREM core fragments or TREM fragments can be modified with non-naturally occurring modifications to, e.g., increase the level and/or activity (e.g., stability) of the TREM. Pharmaceutical TREM compositions, e.g., comprising TREMs having a non-naturally occurring modification, can be administered to cells, tissues or subjects to modulate these functions, e.g., in vitro or in vivo. Disclosed herein are TREMs, TREM core fragments or TREM fragments comprising non-naturally occurring modifications, TREM compositions, preparations, methods of making TREM compositions and preparations, and methods of using the same.

Additional features of any of the aforesaid TREMs, TREM core fragments, TREM fragments, TREM compositions, preparations, methods of making TREM compositions and preparations, and methods of using TREM compositions and preparations include one or more of the features in the Enumerated Embodiments, Figures, Description, Examples, or Claims.

Those skilled in the art will recognize or be able to ascertain using no more than routine experimentation, many equivalents to the specific embodiments of the invention described herein. Such equivalents are intended to be encompassed by the following Enumerated Embodiments, Figures, Description, Examples, or Claims.

BRIEF DESCRIPTION OF THE DRAWINGS

FIG. 1 is a schematic illustrating the activity (log 2 fold change) of modified TREMs containing a 2'-OMe, 2'-F, 2'-OME, 2'-deoxy, and PS modification at each position along an exemplary TREM sequence (TREM-Arg-TGA) over an unmodified TREM, as outlined in Example 11.

ENUMERATED EMBODIMENTS

Enumerated Embodiments I

1. A TREM comprising a sequence of Formula A:

[L1]-[ASt Domain1]-[L2]-[DH Domain]-[L3]-[ACH Domain]-[VL Domain]-[TH Domain]-[LA]-[ASt Domain2], wherein:
independently, [L1] and [VL Domain], are optional;
one of [L1], [ASt Domain1], [L2]-[DH Domain], [L3], [ACH Domain], [VL Domain], [TH Domain], [L4], and [ASt Domain2] comprises a nucleotide having a non-naturally occurring modification; and
wherein:
(a) the TREM has the ability to: support protein synthesis, be charged by a synthetase, be bound by an elongation factor, introduce an amino acid into a peptide chain, support elongation, or support initiation;
(b) the TREM comprises at least X contiguous nucleotides without a non-naturally occurring modification, wherein X is greater than 10;
(c) at least 3, but less than all of the nucleotides of a type (e.g., A, T, C, G or U) comprise the same non-naturally occurring modification;
(d) at least X nucleotides of a type (e.g., A, T, C, G or U) do not comprise a non-naturally occurring modification, wherein x=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50;
(e) no more than 5, 10, or 15 nucleotides of a type (e.g., A, T, C, G or U) comprise a non-naturally occurring modification; and/or
(f) no more than 5, 10, or 15 nucleotides of a type (e.g., A, T, C, G or U) do not comprise a non-naturally occurring modification.
2. The TREM of embodiment 1, comprising the feature provided in embodiment 1 (a).
3. The TREM of embodiment 1, comprising the feature provided in embodiment 1 (b).
4. The TREM of embodiment 1, comprising the feature provided in embodiment 1 (c).
5. The TREM of embodiment 1, comprising the feature provided in embodiment 1 (d).
6. The TREM of embodiment 1, comprising the feature provided in embodiment 1 (e).
7. The TREM of embodiment 1, comprising the feature provided in embodiment 1 (f).
8. The TREM of embodiment 1, comprising all of the features provided in embodiments 1 (a)-(f).

9. The TREM of any one of embodiments 1-8, wherein the Domain comprising the non-naturally occurring modification has a function, e.g., a domain function described herein.
10. The TREM of any one of embodiments 1-8, comprising an [L1]. 11. The TREM of any one of embodiments 1-8, comprising a [VL Domain].
12. The TREM of any one of embodiments 1-8, wherein: [L1] is a linker comprising a nucleotide having a non-naturally occurring modification.
13. The TREM of any one of embodiments 1-8, wherein [ASt Domain1 (AstD1)] comprises a nucleotide having a non-naturally occurring modification.
14. The TREM of any one of embodiments 1-8, wherein [L2] is a linker comprising a nucleotide having a non-naturally occurring modification.
15. The TREM of any one of embodiments 1-8, wherein [DH Domain (DHD)] comprises a nucleotide having a non-naturally occurring modification.
16. The TREM of any one of embodiments 1-8, wherein [L3] is a linker comprising a nucleotide having a non-naturally occurring modification.
17. The TREM of any one of embodiments 1-8, wherein [ACH Domain (ACHD)] comprises a nucleotide having a non-naturally occurring modification.
18. The TREM of any one of embodiments 1-8, wherein [VL Domain (VLD)] comprises a nucleotide having a non-naturally occurring modification.
19. The TREM of any one of embodiments 1-8, wherein [TH Domain (THD)] comprises a nucleotide having a non-naturally occurring modification.
20. The TREM of any one of embodiments 1-8, wherein [L4] is a linker comprises a nucleotide having a non-naturally occurring modification.
21. The TREM of any one of embodiments 1-8, wherein: [ASt Domain2 (AStD2)] comprises a nucleotide having a non-naturally occurring modification.
22. A TREM core fragment comprising a sequence of Formula B:

[L1]$_y$-[ASt Domain1]$_x$-[L2]$_y$-[DH Domain]$_y$-[L3]$_y$-[ACH Domain]-[VL Domain]$_y$-[TH Domain]$_y$-[L4]$_y$-[ASt Domain2]$_x$, wherein:
x=1 and γ-0 or 1;
one of [ASt Domain1], [ACH Domain], and [ASt Domain2] comprises a nucleotide having a non-naturally occurring modification; and
the TREM has the ability to: support protein synthesis; be able to be charged by a synthetase, be bound by an elongation factor, introduce an amino acid into a peptide chain, support elongation, or support initiation.
23. The TREM core fragment of embodiment 22, wherein AStD1 and AStD2 comprise an ASt Domain (AStD).
24. The TREM core fragment of embodiment 22, wherein the [ASt Domain 1], and/or [ASt Domain 2] comprising the non-naturally occurring modification has the ability to initiate or elongate a polypeptide chain.
25. The TREM core fragment of embodiment 22, wherein the [ACH Domain] comprising the non-naturally occurring modification has the ability to mediate pairing with a codon.
26. The TREM core fragment of embodiment 22, wherein y=1 for any one, two, three, four, five, six, all or a combination of [L1], [L2], [DH Domain], [L3], [VL Domain], [TH Domain], [L4].

27. The TREM core fragment of embodiment 22, wherein y=0 for any one, two, three, four, five, six, all or a combination of [L1], [L2], [DH Domain], [L3], [VL Domain], [TH Domain], [L4].

28. The TREM core fragment of embodiment 22, wherein y=1 for linker [L1], and L1 comprises a nucleotide having a non-naturally occurring modification.

29. The TREM core fragment of embodiment 22, wherein y=1 for linker [L2], and L2 comprises a nucleotide having a non-naturally occurring modification.

30. The TREM core fragment of embodiment 22, wherein y=1 for [DH Domain (DHD)], and DHD comprises a nucleotide having a non-naturally occurring modification.

31. The TREM core fragment of embodiment 30, wherein the DHD comprising the non-naturally occurring modification has the ability to mediate recognition of aminoacyl-tRNA synthetase.

32. The TREM core fragment of embodiment 22, wherein y=1 for linker [L3], and L3 comprises a nucleotide having a non-naturally occurring modification.

33. The TREM core fragment of embodiment 22, wherein y=1 for [VL Domain (VLD)], and VLD comprises a nucleotide having a non-naturally occurring modification.

34. The TREM core fragment of embodiment 22, wherein y=1 for [TH Domain (THD)], and THD comprises a nucleotide having a non-naturally occurring modification.

35. The TREM core fragment of embodiment 34, wherein the THD comprising the non-naturally occurring modification has the ability to mediate recognition of the ribosome.

36. The TREM core fragment of embodiment 22, wherein y=1 for linker [L4], and L4 comprises a nucleotide having a non-naturally occurring modification.

37. A TREM fragment comprising a portion of a TREM, wherein the TREM comprises a sequence of Formula A:

[L1]-[ASt Domain1]-[L2]-[DH Domain]-[L3]-[ACH Domain]-[VL Domain]-[TH Domain]-[L4]-[ASt Domain2], and wherein:

the TREM fragment comprises:
a non-naturally occurring modification; and one, two, three or all or any combination of the following:
(a) a TREM half (e.g., from a cleavage in the ACH Domain, e.g., in the anticodon sequence, e.g., a 5'half or a 3' half);
(b) a 5' fragment (e.g., a fragment comprising the 5' end, e.g., from a cleavage in a DH Domain or the ACH Domain);
(c) a 3' fragment (e.g., a fragment comprising the 3' end, e.g., from a cleavage in the TH Domain); or
(d) an internal fragment (e.g., from a cleavage in any one of the ACH Domain, DH Domain or TH Domain).

38. The TREM of embodiment 37, wherein the TREM fragment comprise (a) a TREM half which comprises a nucleotide having a non-naturally occurring modification.

39. The TREM of embodiment 37, wherein the TREM fragment comprise (b) a 5' fragment which comprises a nucleotide having a non-naturally occurring modification.

40. The TREM of embodiment 37, wherein the TREM fragment comprise (c) a 3' fragment which comprises a nucleotide having a non-naturally occurring modification.

41. The TREM of embodiment 37, wherein the TREM fragment comprise (d) an internal fragment which comprises a nucleotide having a non-naturally occurring modification.

42. The TREM of any one of embodiments 1-8, the TREM core fragment of embodiment 22, or the TREM fragment of embodiment 37, wherein the TREM Domain comprises a plurality of nucleotides each having a non-naturally occurring modification.

43. The TREM of any one of embodiments 1-8, the TREM core fragment of embodiment 22, or the TREM fragment of embodiment 37, wherein at least X of the nucleotides of AStD1 have a non-naturally occurring modification, wherein X is equal to or greater than 1, 2, 3, 4, 5, 6 or 7.

44. The TREM of any one of embodiments 1-8, the TREM core fragment of embodiment 22, or the TREM fragment of embodiment 37, wherein no more than X of the nucleotides of AStD1 have a non-naturally occurring modification, wherein X is equal to or greater than 1, 2, 3, 4, 5, 6 or 7.

45. The TREM of any one of embodiments 1-8, the TREM core fragment of embodiment 22, or the TREM fragment of embodiment 37, wherein at least X of the nucleotides of AStD2 have a non-naturally occurring modification, wherein X is equal to or greater than 1, 2, 3, 4, 5, 6 or 7.

46. The TREM of any one of embodiments 1-8, the TREM core fragment of embodiment 22, or the TREM fragment of embodiment 37, wherein no more than X of the nucleotides of AStD2 have a non-naturally occurring modification, wherein X is equal to or greater than 1, 2, 3, 4, 5, 6 or 7.

47. The TREM of any one of embodiments 1-8, the TREM core fragment of embodiment 22, or the TREM fragment of embodiment 37, wherein at least X of the nucleotides of ACHD have a non-naturally occurring modification, wherein X is equal to or greater than 1, 2, 3, 4, 5, 6, 7, 8, 9, or 10.

48. The TREM of any one of embodiments 1-8, the TREM core fragment of embodiment 22, or the TREM fragment of embodiment 37, wherein at least X of the nucleotides of ACHD have a non-naturally occurring modification, wherein X is equal to or greater than 11, 12, 13, 14, 15, 16, or 17.

49. The TREM of any one of embodiments 1-8, the TREM core fragment of embodiment 22, or the TREM fragment of embodiment 37, wherein no more than X of the nucleotides of ACHD have a non-naturally occurring modification, wherein X is equal to or greater than 1, 2, 3, 4, 5; 6, 7, 8, 9, or 10.

50. The TREM of any one of embodiments 1-8, the TREM core fragment of embodiment 22, or the TREM fragment of embodiment 37, wherein no more than X of the nucleotides of ACHD have a non-naturally occurring modification, wherein X is equal to or greater than 11, 12, 13, 14, 15, or 16.

51. The TREM of any one of embodiments 1-8, the TREM core fragment of embodiment 22, or the TREM fragment of embodiment 37, wherein at least X of the nucleotides of THD have a non-naturally occurring modification, wherein X is equal to or greater than 1, 2, 3, 4, 5, 6, 7, 8, 9, or 10.

52. The TREM of any one of embodiments 1-8, the TREM core fragment of embodiment 22, or the TREM fragment of embodiment 37, wherein at least X of the nucleotides of THD have a non-naturally occurring modification, wherein X is equal to or greater than 11, 12, 13, 14, 15, 16, or 17.

53. The TREM of any one of embodiments 1-8, the TREM core fragment of embodiment 22, or the TREM fragment of embodiment 37, wherein no more than X of the nucleotides of THD have a non-naturally occurring modification, wherein X is equal to or greater than 1, 2, 3, 4, 5, 6, 7, 8, 9, or 10.

54. The TREM of any one of embodiments 1-8, the TREM core fragment of embodiment 22, or the TREM fragment of embodiment 37, wherein no more than X of the nucleotides of THD have a non-naturally occurring modification, wherein X is equal to or greater than 11, 12, 13, 14, 15, or 16.

55. The TREM of any one of embodiments 1-8, the TREM core fragment of embodiment 22, or the TREM fragment of embodiment 37, wherein at least X of the nucleotides of DHD have a non-naturally occurring modification, wherein X is equal to or greater than 2, 3, 4, 5, 6, 7, 8, 9 or 10.

56. The TREM of any one of embodiments 1-8, the TREM core fragment of embodiment 22, or the TREM fragment of embodiment 37, wherein at least X of the nucleotides of DHD have a non-naturally occurring modification, wherein X is equal to or greater than 11, 12, 13, 14, 15, 16, 17, 18 or 19.

57. The TREM of any one of embodiments 1-8, the TREM core fragment of embodiment 22, or the TREM fragment of embodiment 37, wherein no more than X of the nucleotides of DHD have a non-naturally occurring modification, wherein X is equal to or greater than 1, 2, 3, 4, 5, 6, 7, 8, 9, or 10.

58. The TREM of any one of embodiments 1-8, the TREM core fragment of embodiment 22, or the TREM fragment of embodiment 37, wherein no more than X of the nucleotides of DHD have a non-naturally occurring modification, wherein X is equal to or greater than 11, 12, 13, 14, 15, 16, 17, or 18.

59. The TREM of any one of embodiments 1-8, the TREM core fragment of embodiment 22, or the TREM fragment of embodiment 37, wherein at least X of the nucleotides of the VLD have a non-naturally occurring modification, wherein X is equal to or greater than 2, 3, 4, 5, 6, 7, 8, 9, 10, 11, 12, 13, 14, 15, 16, 17, 18, 19, 20, 50, 100, 150, 200 or 271.

60. The TREM of any one of embodiments 1-8, the TREM core fragment of embodiment 22, or the TREM fragment of embodiment 37, wherein all of the nucleotides of the AStD1, AStD2, ACHD, DHD, and/or THD have a non-naturally occurring modification.

61. The TREM of any one of embodiments 1-8, the TREM core fragment of embodiment 22, or the TREM fragment of embodiment 37, wherein at least X of the nucleotides of AStD1 and/or AStD2 do not have a non-naturally occurring modification, wherein X is equal to or greater than 1, 2, 3, 4, 5, 6 or 7.

62. The TREM of any one of embodiments 1-8, the TREM core fragment of embodiment 22, or the TREM fragment of embodiment 37, wherein at least X of the nucleotides of ACHD do not have a non-naturally occurring modification, wherein X is equal to or greater than 1, 2, 3, 4, 5, 6, 7, 8, 9, 10, 11, 12, 13, 14, 15, 16, or 17.

63. The TREM of any one of embodiments 1-8, the TREM core fragment of embodiment 22, or the TREM fragment of embodiment 37, wherein at least X of the nucleotides of THD do not have a non-naturally occurring modification, wherein X is equal to or greater than 1, 2, 3, 4, 5, 6, 7, 8, 9, 10, 11, 12, 13, 14, 15, 16, or 17.

64. The TREM of any one of embodiments 1-8, the TREM core fragment of embodiment 22, or the TREM fragment of embodiment 37, wherein at least X of the nucleotides of DHD do not have a non-naturally occurring modification, wherein X is equal to or greater than 1, 2, 3, 4, 5, 6, 7, 8, 9, 10, 11, 12, 13, 14, 15, 16, 17, 18 or 19.

65. The TREM of any one of embodiments 1-8, the TREM core fragment of embodiment 22, or the TREM fragment of embodiment 37, wherein at least X of the nucleotides of VLD do not have a non-naturally occurring modification, wherein X is equal to or greater than 1, 2, 3, 4, 5, 6, 7, 8, 9, 10, 11, 12, 13, 14, 15, 16, 17, 18, 19, 20, 50, 100, 150, 200 or 271.

66. The TREM of any one of embodiments 1-8, the TREM core fragment of embodiment 22, or the TREM fragment of embodiment 37, wherein the TREM Linker L2 comprises two nucleotides each having a non-naturally occurring modification.

67. The TREM of any one of embodiments 1-8, the TREM core fragment of embodiment 22, or the TREM fragment of embodiment 37, wherein at least X of the nucleotides of the TREM Linker do not have a non-naturally occurring modification, wherein X is equal to 1 or 2.

68. The TREM of any one of embodiments 1-8, the TREM core fragment of embodiment 22, or the TREM fragment of embodiment 37, wherein:

each of a plurality of TREM Domains and Linkers comprises a nucleotide having a non-naturally occurring modification.

69. The TREM, TREM core fragment or TREM fragment of embodiment 68, wherein one of the TREM Domains and Linkers of the plurality comprises a plurality of nucleotides each having a non-naturally occurring modification.

70. The TREM, TREM core fragment or TREM fragment of any of the preceding embodiments, wherein the non-naturally occurring modification is a modification in a base or a backbone of a nucleotide, e.g., a modification chosen from any one of Tables 5-9.

71. The TREM, TREM core fragment or TREM fragment of any of the preceding embodiments, wherein the non-naturally occurring modification is a base modification chosen from a modification listed in Table 5.

72. The TREM, TREM core fragment or TREM fragment of any of the preceding embodiments, wherein the non-naturally occurring modification is a base modification chosen from a modification listed in Table 6.

73. The TREM, TREM core fragment or TREM fragment of any of the preceding embodiments, wherein the non-naturally occurring modification is a base modification chosen from a modification listed in Table 7.

74. The TREM, TREM core fragment or TREM fragment of any of the preceding embodiments, wherein the non-naturally occurring modification is a backbone base modification chosen from a modification listed in Table 8.

75. The TREM, TREM core fragment or TREM fragment of any of the preceding embodiments, wherein the non-naturally occurring modification is a backbone modification chosen from a modification listed in Table 9.

76. The TREM of any one of embodiments 1-8, the TREM core fragment of embodiment 22, or the TREM fragment of embodiment 37, comprising a nucleotide of a first type comprising a non-naturally occurring modification.

77. The TREM of any one of embodiments 1-8, the TREM core fragment of embodiment 22, or the TREM fragment of embodiment 37, comprising a nucleotide of a first type and a nucleotide of a second type comprising a non-naturally occurring modification.

78. The TREM, TREM core fragment or TREM fragment of embodiment 77, wherein the non-naturally occurring modification on the nucleotide of the first type and the non-naturally occurring modification on the nucleotide of the second type are the same non-naturally occurring modification.

79. The TREM, TREM core fragment or TREM fragment of embodiment 77, wherein the non-naturally occurring modification on the nucleotide of the first type and the non-naturally occurring modification on the nucleotide of the second type are different non-naturally occurring modifications.

80. The TREM, TREM core fragment or TREM fragment of embodiments 76 or 77, wherein the nucleotide of the first type is chosen from: A, T, C, G or U.

81. The TREM, TREM core fragment or TREM fragment of embodiments 76 or 77, wherein the nucleotide of the second type is chosen from: A, T, C, G or U.

82. The TREM, TREM core fragment or TREM fragment of embodiments 76 or 77, wherein the nucleotide of the first type is an A.

83. The TREM, TREM core fragment or TREM fragment of embodiments 76 or 77, wherein the nucleotide of the first type is a G.

84. The TREM, TREM core fragment or TREM fragment of embodiments 76 or 77, wherein the nucleotide of the first type is a C.

85. The TREM core fragment or TREM fragment of embodiments 76 or 77, wherein the nucleotide of the first type is a T.

86. The TREM, TREM core fragment or TREM fragment of embodiments 76 or 77, wherein the nucleotide of the first type is a U.

87. The TREM, TREM core fragment or TREM fragment of embodiment 77, wherein when the nucleotide of the first type is an A, the nucleotide of the second type is chosen from: T, C, G or U.

88. The TREM, TREM core fragment or TREM fragment of embodiment 77, wherein when the nucleotide of the first type is a G, the nucleotide of the second type is chosen from: T, C, A or U.

89. The TREM, TREM core fragment or TREM fragment of embodiment 77, wherein when the nucleotide of the first type is a C, the nucleotide of the second type is chosen from: T, A, G or U.

90. The TREM, TREM core fragment or TREM fragment of embodiment 77, wherein when the nucleotide of the first type is a T, the nucleotide of the second type is chosen from: A, C, G or U.

91. The TREM, TREM core fragment or TREM fragment of embodiment 77, wherein when the nucleotide of the first type is a U, the nucleotide of the second type is chosen from: T, C, G or A.

92. The TREM of any one of embodiments 1-8, the TREM core fragment of embodiment 22, or the TREM fragment of embodiment 37, wherein the non-naturally modification is in a purine (A or G).

93. The TREM of any one of embodiments 1-8, the TREM core fragment of embodiment 22, or the TREM fragment of embodiment 37, wherein the non-naturally modification is not in a purine (A or G).

94. The TREM of any one of embodiments 1-8, the TREM core fragment of embodiment 22, or the TREM fragment of embodiment 37, wherein the non-naturally modification is in a pyrimidine (U, T or C).

95. The TREM of any one of embodiments 1-8, the TREM core fragment of embodiment 22, or the TREM fragment of embodiment 37, wherein the non-naturally modification is not in a pyrimidine (U, T or C).

96. The TREM of any one of embodiments 1-8, the TREM core fragment of embodiment 22, or the TREM fragment of embodiment 37, wherein the DHD has a first sequence, a second sequence and a third sequence, optionally wherein the first sequence and the third sequence form a stem and the second sequence forms a loop, e.g., under physiological conditions.

97. The TREM, TREM core fragment or TREM fragment of embodiment 96, wherein the DHD comprises a non-naturally occurring modification in the first sequence or the third sequence, e.g., in the stem.

98. The TREM, TREM core fragment or TREM fragment of embodiment 96, wherein the DHD comprises a non-naturally occurring modification in the second sequence, e.g., in the loop.

100. The TREM of any one of embodiments 1-8, the TREM core fragment of embodiment 22, or the TREM fragment of embodiment 37, wherein the ACHD has a first sequence, a second sequence and a third sequence, optionally wherein the first sequence and the third sequence form a stem and the second sequence forms a loop, e.g., under physiological conditions.

101. The TREM, TREM core fragment or TREM fragment of embodiment 100, wherein the ACHD comprises a non-naturally occurring modification in the first sequence or the third sequence, e.g., in the stem.

102. The TREM, TREM core fragment or TREM fragment of embodiment 100, wherein the ACHD comprises a non-naturally occurring modification in the second sequence, e.g., in the loop.

103. The TREM of any one of embodiments 1-8, the TREM core fragment of embodiment 22, or the TREM fragment of embodiment 37, wherein the THD has a first sequence, a second sequence and a third sequence, optionally wherein the first sequence and the third sequence form a stem and the second sequence forms a loop, e.g., under physiological conditions.

104. The TREM, TREM core fragment or TREM fragment of embodiment 103, wherein the THD comprises a non-naturally occurring modification in the first sequence or the third sequence, e.g., in the stem.

105. The TREM, TREM core fragment or TREM fragment of embodiment 103, wherein the THD comprises a non-naturally occurring modification in the second sequence, e.g., in the loop.

106. The TREM of any one of embodiments 1-8, the TREM core fragment of embodiment 22, or the TREM fragment of embodiment 37, wherein the VLD comprises a variable region having 1-271 nucleotides.

107. The TREM of any one of embodiments 1-8, the TREM core fragment of embodiment 22, or the TREM fragment of embodiment 37, wherein the TREM comprises at least X contiguous nucleotides without a non-naturally occurring modification, wherein X is greater than 10.

108. The TREM of any one of embodiments 1-8, the TREM core fragment of embodiment 22, or the TREM fragment of embodiment 37, wherein at least 3, but less than all of the nucleotides of a type (e.g., A, T, C, G or U) comprise the same non-naturally occurring modification.

109. The TREM of any one of embodiments 1-8, the TREM core fragment of embodiment 22, or the TREM fragment of embodiment 37, wherein at least X nucleotides of a type (e.g., A, T, C, G or U) do not comprise a non-naturally occurring modification, wherein x=1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50.

110. The TREM of any one of embodiments 1-8, the TREM core fragment of embodiment 22, or the TREM fragment of embodiment 37, wherein no more than 5, 10, or 15 of a type (e.g., A, T, C, G or U) comprise a non-naturally occurring modification.

111. The TREM of any one of embodiments 1-8, the TREM core fragment of embodiment 22, or the TREM fragment of embodiment 37, wherein no more than 5, 10, or 15 of a type (e.g., A, T, C, G or U) do not comprise a non-naturally occurring modification.

112. The TREM of any one of embodiments 1-8, the TREM core fragment of embodiment 22, or the TREM fragment of embodiment 37, which specifies X, wherein X is an amino acid selected from alanine, arginine, asparagine, aspartate, cysteine, glutamine, glutamate, glycine, histidine, isoleucine, methionine, leucine, lysine, phenylalanine, proline, serine, threonine, tryptophan, tyrosine, or valine.

113. The TREM of any one of embodiments 1-8, the TREM core fragment of embodiment 22, or the TREM fragment of embodiment 37, which recognizes a codon provided in Table 8 or Table 9.

114. The TREM of any one of embodiments 1-8, the TREM core fragment of embodiment 22, or the TREM fragment of embodiment 37, wherein the TREM is a cognate TREM.

115. The TREM of any one of embodiments 1-8, the TREM core fragment of embodiment 22, or the TREM fragment of embodiment 37, wherein the TREM is a non-cognate TREM.

116. The TREM of any one of embodiments 1-8, the TREM core fragment of embodiment 22, or the TREM fragment of embodiment 37, wherein the TREM, TREM core fragment, or TREM fragment is encoded by a sequence provided in Table 1, e.g., any one of SEQ ID NOs 1-451.

117. The TREM of any one of embodiments 1-8, the TREM core fragment of embodiment 22, or the TREM fragment of embodiment 37, wherein the TREM, TREM core fragment, or TREM fragment is encoded by a consensus sequence chosen from any one of SEQ ID NOs: 562-621.

118. The TREM of any one of embodiments 1-8, the TREM core fragment of embodiment 22, or the TREM fragment of embodiment 37, wherein the TREM, TREM core fragment, or TREM fragment is encoded by a consensus sequence chosen from any one of SEQ ID NOs: 622-1187.

119. A pharmaceutical composition comprising a TREM of any one of embodiments 1-8, the TREM core fragment of embodiment 22, or the TREM fragment of embodiment 37.

120. The pharmaceutical composition of embodiment 119, comprising a pharmaceutically acceptable component, e.g., an excipient.

121. A lipid nanoparticle formulation comprising a TREM of any one of embodiments 1-8, the TREM core fragment of embodiment 22, or the TREM fragment of embodiment 37.

122. A method of making a TREM of any one of embodiments 1-8, the TREM core fragment of embodiment 22, or the TREM fragment of embodiment 37, comprising linking a first nucleotide to a second nucleotide to form the TREM.

123. The method of embodiment 122, wherein the TREM, TREM core fragment or TREM fragment is synthetic (e.g, non-naturally occurring).

124. The method of embodiment 122 or 123, wherein the synthesis is performed in vitro.

125. The method of embodiment 122, wherein the TREM, TREM core fragment or TREM fragment is made by cell-free solid phase synthesis.

126. A cell comprising a TREM of any one of embodiments 1-8, the TREM core fragment of embodiment 22, or the TREM fragment of embodiment 37.

127. A cell comprising a TREM, TREM core fragment or TREM fragment made according to the method of embodiment 122.

128. A method of modulating a tRNA pool in a cell comprising:
    providing a TREM of any one of embodiments 1-8, the TREM core fragment of embodiment 22, or the TREM fragment of embodiment 37, and
    contacting the cell with the TREM, TREM core fragment or TREM fragment,
    thereby modulating the tRNA pool in the cell.

129. A method of contacting a cell, tissue, or subject with a TREM of any one of embodiments 1-8, the TREM core fragment of embodiment 22, or the TREM fragment of embodiment 37, comprising
    contacting the cell, tissue or subject with the TREM, TREM core fragment or TREM fragment,
    thereby contacting the cell, tissue, or subject with the TREM, TREM core fragment or TREM fragment.

130. A method of presenting a TREM, TREM core fragment or TREM fragment to a cell, tissue, or subject with a TREM, TREM core fragment or TREM fragment, comprising
    contacting the cell, tissue or subject with a TREM of any one of embodiments 1-8, the TREM core fragment of embodiment 22, or the TREM fragment of embodiment 37, thereby presenting the TREM, TREM core fragment or TREM fragment to a cell, tissue, or subject.

131. A method of forming a TREM, TREM core fragment or TREM fragment-contacted cell, tissue, or subject, comprising
    contacting the cell, tissue or subject with a TREM of any one of embodiments 1-8, the TREM core fragment of embodiment 22, or the TREM fragment of embodiment 37, thereby forming a TREM, TREM core fragment or TREM fragment-contacted cell, tissue, or subject.

132. A method of using a TREM, TREM core fragment or TREM fragment comprising, contacting the cell, tissue or subject with a TREM of any one of embodiments 1-8, the TREM core fragment of embodiment 22, or the TREM fragment of embodiment 37, thereby using the TREM.

133. A method of applying a TREM, TREM core fragment or TREM fragment to a cell, tissue, or subject, comprising
    contacting the cell, tissue or subject with a TREM of any one of embodiments 1-8, the TREM core fragment of embodiment 22, or the TREM fragment of embodiment 37, thereby applying a TREM, TREM core fragment or TREM fragment to a cell, tissue, or subject.

134. A method of exposing a cell, tissue, or subject to a TREM, comprising
    contacting the cell, tissue or subject with a TREM of any one of embodiments 1-8, the TREM core fragment of embodiment 22, or the TREM fragment of embodiment 37, thereby exposing a cell, tissue, or subject to a TREM, TREM core fragment or TREM fragment.

135. A method of forming an admixture of a TREM, TREM core fragment or TREM fragment and a cell, tissue, or subject, comprising
    contacting the cell, tissue or subject with a TREM of any one of embodiments 1-8, the TREM core fragment of embodiment 22, or the TREM fragment of embodiment 37, thereby forming an admixture of a TREM, TREM core fragment or TREM fragment and a cell, tissue, or subject.

136. A method of delivering a TREM, TREM core fragment or TREM fragment to a cell, tissue, or subject, comprising:

providing a cell, tissue, or subject, and contacting the cell, tissue, or subject, a TREM of any one of embodiments 1-8, the TREM core fragment of embodiment 22, or the TREM fragment of embodiment 37.

137. A method, e.g., an ex vivo method, of modulating the metabolism, e.g., the translational capacity of an organelle, comprising:

providing a preparation of an organelle, e.g., mitochondria or chloroplasts, and contacting the organelle with a TREM of any one of embodiments 1-8, the TREM core fragment of embodiment 22, or the TREM fragment of embodiment 37.

138. A method of treating a subject, e.g., modulating the metabolism, e.g., the translational capacity of a cell, in a subject, comprising:

providing, e.g., administering to the subject a TREM of any one of embodiments 1-8, the TREM core fragment of embodiment 22, or the TREM fragment of embodiment 37, thereby treating the subject.

139. A method of modulating a tRNA pool in a cell comprising an endogenous open reading frame (ORF), which ORF comprises a codon having a first sequence, comprising:

optionally, acquiring knowledge of the abundance of one or both of (i) and (ii), e.g., acquiring knowledge of the relative amounts of: (i) and (ii) in the cell, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the cell;

contacting the cell with a TREM of any one of embodiments 1-8, the TREM core fragment of embodiment 22, or the TREM fragment of embodiment 37, wherein the TREM, TREM core fragment or TREM fragment has an anticodon that pairs with: the codon having the first sequence; or the codon other than the codon having the first sequence, in an amount and/or for a time sufficient to modulate the relative amounts of the first tRNA moiety and the second tRNA moiety in the cell, thereby modulating the tRNA pool in the cell.

140. A method of modulating a tRNA pool in a subject having an endogenous open reading frame (ORF), which ORF comprises a codon having a first sequence, comprising:

optionally, acquiring knowledge of the abundance of one or both of (i) and (ii), e.g., acquiring knowledge of the relative amounts of: (i) and (ii) in the subject, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the subject;

contacting the subject with a TREM of any one of embodiments 1-8, the TREM core fragment of embodiment 22, or the TREM fragment of embodiment 37, wherein the TREM, TREM core fragment or TREM fragment has an anticodon that pairs with: the codon having the first sequence; or the codon other than the codon having the first sequence, in an amount and/or for a time sufficient to modulate the relative amounts of the first tRNA moiety and the second tRNA moiety in the subject, thereby modulating the tRNA pool in the subject.

141. A method of modulating a tRNA pool in a subject having an endogenous open reading frame (ORF) comprising a codon comprising a synonymous mutation (a synonymous mutation codon or SMC), comprising:

providing a composition comprising a TREM of any one of embodiments 1-8, the TREM core fragment of embodiment 22, or the TREM fragment of embodiment 37, wherein the TREM, TREM core fragment or TREM fragment comprises an isoacceptor tRNA moiety comprising an anticodon sequence that pairs with the SMC (the TREM);

contacting the subject with the composition in an amount and/or for a time sufficient to modulate the tRNA pool in the subject, thereby modulating the tRNA pool in the subject.

142. A method of modulating a tRNA pool in a cell comprising an endogenous open reading frame (ORF) comprising a codon comprising a synonymous mutation (a synonymous mutation codon or SMC), comprising:

providing a composition comprising a TREM of any one of embodiments 1-8, the TREM core fragment of embodiment 22, or the TREM fragment of embodiment 37, wherein the TREM, TREM core fragment or TREM fragment comprises an isoacceptor tRNA moiety comprising an anticodon sequence that pairs with the SMC (the TREM);

contacting the cell with the composition comprising a TREM in an amount and/or for a time sufficient to modulate the tRNA pool in the cell, thereby modulating the tRNA pool in the cell.

143. A method of modulating expression of a protein in a cell, wherein the protein is encoded by a nucleic acid comprising an endogenous open reading frame (ORF), which ORF comprises a codon having a mutation, comprising:

contacting the cell with a composition comprising a TREM of any one of embodiments 1-8, the TREM core fragment of embodiment 22, or the TREM fragment of embodiment 37 in an amount and/or for a time sufficient to modulate expression of the encoded protein, wherein the TREM, TREM core fragment or TREM fragment has an anticodon that pairs with the codon having the mutation, thereby modulating expression of the protein in the cell.

144. A method of modulating expression of a protein in a subject, wherein the protein is encoded by a nucleic acid comprising an endogenous open reading frame (ORF), which ORF comprises a codon having a mutation, comprising:

contacting the subject with a composition comprising a TREM of any one of embodiments 1-8, the TREM core fragment of embodiment 22, or the TREM fragment of embodiment 37, in an amount and/or for a time sufficient to modulate expression of the encoded protein, wherein the TREM, TREM core fragment or TREM fragment has an anticodon that pairs with the codon having the mutation, thereby modulating expression of the protein in the subject.

145. The method of embodiment 143 or 144, wherein the mutation in the ORF is a nonsense mutation, e.g., resulting in a premature stop codon chosen from UAA, UGA or UAG.

146. The method of embodiment 143 or 144, wherein the TREM comprises an anticodon that pairs with a stop codon.

Enumerated Embodiments II

1000. A TREM comprising a nucleotide (at a position identified herein) comprising a non-naturally occurring modification or a nucleotide (at a position identified herein) lacking a non-naturally occurring modification.

1001. The TREM of embodiment 1000, comprising the following structure:

> [L1]-[ASt Domain1]-[L2]-[DH Domain]-[L3]-[ACH Domain]-[VL Domain]-[TH Domain]-[L4]-[ASt Domain2].

1002. A TREM comprising a sequence of Formula A:

> [L1]-[ASt Domain1]-[L2]-[DH Domain]-[L3]-[ACH Domain]-[VL Domain]-[TH Domain]-[L4]-[ASt Domain2], wherein:

independently, [L1] and [VL Domain], are optional;

one of [L1], [ASt Domain1], [L2]-[DH Domain], [L3], [ACH Domain], [VL Domain], [TH Domain], [L4], and [ASt Domain2] comprises a nucleotide having a non-naturally occurring modification; and wherein:

(a) the TREM has the ability to: (i) support protein synthesis, (ii) be charged by a synthetase, (iii) be bound by an elongation factor, (iv) introduce an amino acid into a peptide chain, (v) support elongation, or (vi) support initiation;

(b) the TREM comprises $X_1$ contiguous nucleotides without a non-naturally occurring modification, wherein $X_1$ is 3, 4, 5, 6, 7, 8, 9, 10 or greater;

(c) the TREM comprises $X_2$ non-naturally occurring modifications, wherein $X_2$ is, 2, 3, 4, or greater;

(d) the TREM comprises $X_3$ different non-naturally occurring modifications, wherein $X_3$ is, 2, 3, 4, or greater;

(e) 3 nucleotides, wherein less than all of the nucleotides of a type (e.g., A, T, C, G or U) comprise the same non-naturally occurring modification;

(f) $X_4$ nucleotides of a type (e.g., A, T, C, G or U) do not comprise a non-naturally occurring modification, wherein $X_4$ is equal to or greater than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50;

(g) no more than 5, 10, or 15 nucleotides of a type (e.g., A, T, C, G or U) comprise a non-naturally occurring modification; and/or (h) no more than 5, 10, or 15 nucleotides of a type (e.g., A, T, C, G or U) do not comprise a non-naturally occurring modification; and/or the ACH Domain comprises a non-extended anticodon.

1003. The TREM of any preceding embodiment, wherein:

(a) the TREM has the ability to: (i) support protein synthesis, (ii) be charged by a synthetase, (iii) be bound by an elongation factor, (iv) introduce an amino acid into a peptide chain, (v) support elongation, or (vi) support initiation.

1004. The TREM of any preceding embodiment, wherein:

(b) the TREM comprises $X_1$ contiguous nucleotides without a non-naturally occurring modification, wherein $X_1$ is 10 or greater.

1005. The TREM of any preceding embodiment, wherein: the TREM comprises at $X_2$ non-naturally occurring modifications, wherein $X_2$ is, 2, 3, 4, or greater.

1006. The TREM of any preceding embodiment, wherein:

(c) the TREM comprises $X_3$ different non-naturally occurring modifications, wherein $X_3$ is, 2, 3, 4, or greater.

1007. The TREM of any preceding embodiment, wherein:

(d) 3 nucleotides, wherein less than all of the nucleotides of a type (e.g., A, T, C, G or U) comprise the same non-naturally occurring modification.

1008. The TREM of any preceding embodiment, wherein:

(e) $X_4$ nucleotides of a type (e.g., A, T, C, G or U) do not comprise a non-naturally occurring modification, wherein $X_4$ is equal to or greater than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50.

1009. The TREM of any preceding embodiment, wherein:

(f) no more than 5, 10, or 15 nucleotides of a type (e.g., A, T, C, G or U) comprise a non-naturally occurring modification.

1010. The TREM of any preceding embodiment, wherein:

(g) no more than 5, 10, or 15 nucleotides of a type (e.g., A, T, C, G or U) do not comprise a non-naturally occurring modification; and/or the ACH Domain comprises a non-extended anticodon.

1011. The TREM of any preceding embodiment wherein the ACH Domain comprises a non-extended anticodon or does not include an extended anticodon.

1012. A TREM fragment comprising a portion of a TREM, wherein the TREM comprises a sequence of Formula A:

> [L1]-[ASt Domain1]-[L2]-[DH Domain]-[L3]-[ACH Domain]-[VL Domain]-[TH Domain]-[L4]-[ASt Domain2], and wherein:

the TREM fragment comprises:

a non-naturally occurring modification; and one, two, three or all or any combination of the following:

(a) a TREM half (e.g., from a cleavage in the ACH Domain, e.g., in the anticodon sequence, e.g., a 5'half or a 3' half);

(b) a 5' fragment (e.g., a fragment comprising the 5' end, e.g., from a cleavage in a DH Domain or the ACH Domain);

(c) a 3' fragment (e.g., a fragment comprising the 3' end, e.g., from a cleavage in the TH Domain); or (d) an internal fragment (e.g., from a cleavage in any one of the ACH Domain, DH Domain or TH Domain).

1013. The TREM or TREM fragment of any of the above embodiments, comprising a non-naturally occurring modification on a nucleotide sugar moiety (2'-modification) or in the TREM backbone.

1014. The TREM or TREM fragment of any of the above embodiments, comprising a nucleotide comprising a 2' non-naturally occurring modification on the sugar moiety.

1015. The TREM or TREM fragment of any of the above embodiments, wherein the nucleotide corresponds to any of nucleotides 1-76 of SEQ ID NO: 622, nucleotides 1-85 of SEQ ID NO: 993, or nucleotides 1-75 of SEQ ID NO: 1079 is modified.

1016. The TREM or TREM fragment of embodiments 1000-1015, wherein the nucleotide is in the ASt Domain1.

1017. The TREM or TREM fragment of embodiments 1000-1016, wherein the nucleotide is in the DH Domain.

1018. The TREM or TREM fragment of embodiments 1000-1017, wherein the nucleotide is in the ACH Domain.

1019. The TREM or TREM fragment of embodiments 1000-1018, wherein the nucleotide is in the VL Domain.

1020. The TREM or TREM fragment of embodiments 1000-1019, wherein the nucleotide is in the TH Domain.

1021. The TREM or TREM fragment of embodiments 1000-1020, wherein the nucleotide is in the ASt Domain2.

1022. The TREM or TREM fragment of embodiments 1000-10021, wherein the nucleotide is in a linker domain (e.g., [L1], [L2], [L3], or [L4]).

1023. The TREM or TREM fragment of embodiments 1000-1022, wherein the nucleotide corresponding to any one of nucleotides 1, 2, 4, 6, 10, 12, 13, 17, 18, 20, 22, 29, 30, 42, 43, 45, 50, 52, 56, 59, 61, 65, 66, 68, 69, 71, 72, and 73 of SEQ ID NO: 622 is modified.

1024. The TREM or TREM fragment of embodiments 1000-1022, wherein the nucleotide corresponding to any one of nucleotides 20, 29, 33, 40, 41, 44, 45, 48, 49, 50, 52, 53, 54, 56, 59, 61, 62, 63, 65, 67, 68, 69, 71, 72, 75, and 76 of SEQ ID NO: 622 is modified.

1025. The TREM or TREM fragment of embodiments 1000-1022, wherein the nucleotide corresponding to any one of nucleotides 1, 4, 14, 15, 16, 17, 20, 29, 44, 45, 47, 49, 50, 52, 54, 56, 57, 59, 65, 72, and 73 of SEQ ID NO: 622 is modified.

1026. The TREM or TREM fragment of embodiments 1000-1022, wherein the nucleotide corresponding to any one of nucleotides 3, 4, 5, 6, 14, 15, 16, 20, 22, 23, 33, 54, 59, 62, 63, 72, and 76 of SEQ ID NO: 622 is modified.

1027. The TREM or TREM fragment of embodiments 1000-1022, wherein the nucleotide corresponding to any one of nucleotides 1, 2, 3, 9, 14, 15, 16, 17, 18, 19, 20, 21, 35, 37, 38, 44, 45, 46, 52, 54, 55, 56, 57, 58, 73, and 74 of SEQ ID NO: 622 is modified.

1028. The TREM or TREM fragment of embodiments 1000-1022, wherein the nucleotide corresponding to any one of nucleotides 1, 17, 18, 20, 29, 30, 50, 52, and 73 of SEQ ID NO: 622 is modified.

1029. The TREM or TREM fragment of embodiments 1000-1022, wherein the nucleotide corresponding to any one of nucleotides 1, 4, 5, 34, 38, 39, 61, 79, 80, and 82 of SEQ ID NO: 993 is modified.

1030. The TREM or TREM fragment of embodiments 1000-1022, wherein the nucleotide corresponding to any one of nucleotides 1, 4, 12, 13, 17, 18, 23, 28, 29, 30, 38, 39, 41, 44, 48, 49, 51, 52, 53, 58, 60, 61, 63, 64, 65, 66, 68, 69, 71, 72, 73, 74, and 75 of SEQ ID NO: 1079 is modified.

1031. The TREM or TREM fragment of embodiments 1000-1014, wherein the 2' non-naturally occurring modification comprises an ester, halo, hydrogen, alkyl group.

1032. The TREM or TREM fragment of embodiments 1000-1014, wherein the 2' non-naturally occurring modification comprises a 2'-OMe moiety.

1033. The TREM or TREM fragment of embodiments 1000-1024, wherein the 2' non-naturally occurring modification comprises a 2'-MOE moiety.

1034. The TREM or TREM fragment of embodiments 1000-1014, wherein the 2' non-naturally occurring modification comprises a 2'-halo (e.g., 2'-F or 2'C1).

1035. The TREM or TREM fragment of embodiments 1000-1014, wherein the 2' non-naturally occurring modification comprises a 2'-deoxy group (e.g., a 2'-H). 1036. The TREM or TREM fragment of any of embodiments 1000-1035, comprising a nucleotide that lacks a non-naturally occurring modification, e.g., lacks a 2' non-naturally occurring modification on a sugar moiety.

1037. The TREM or TREM fragment of any of embodiment 1036, wherein the nucleotide corresponds to any of nucleotides 1-76 of SEQ ID NO:622 and lacks a non-naturally occurring modification.

1038. The TREM or TREM fragment of embodiment 1036, wherein the nucleotide is in the ASt Domain1.

1039. The TREM or TREM fragment of embodiment 1036, wherein the nucleotide is in the DH Domain.

1040. The TREM or TREM fragment of embodiment 1036, wherein the nucleotide is in the ACH Domain.

1041. The TREM or TREM fragment of embodiment 1036, wherein the nucleotide is in the VL Domain.

1042. The TREM or TREM fragment of embodiment 1036, wherein the nucleotide is in the TH Domain. 1043. The TREM or TREM fragment of embodiment 1036, wherein the nucleotide is in the ASt Domain2.

1044. The TREM or TREM fragment of embodiment 1036, wherein the nucleotide is in a linker domain (e.g., [L1], [L2], [L3], or [L4]).

1045. The TREM or TREM fragment of embodiment 1036, wherein the nucleotide corresponds to any one of nucleotides 1-76 of SEQ ID NO: 622 and lacks a non-naturally occurring modification, e.g., 2' non-naturally occurring modification on a sugar.

1046. The TREM or TREM fragment of embodiment 1036, wherein the nucleotide corresponding to any one of nucleotides 1-85 of SEQ ID NO: 993 lacks a non-naturally occurring modification, e.g., a 2' non-naturally occurring modification on a sugar.

1047. The TREM or TREM fragment of embodiment 1036, wherein the nucleotide corresponding to any one of nucleotides 1-75 of SEQ ID NO: 1079 lacks a non-naturally occurring modification, e.g., a 2' non-naturally occurring modification on a sugar.

1048. The TREM or TREM fragment of any one of embodiments 1000-1047, comprising a nucleotide comprising a 2' OMe non-naturally occurring modification.

1049. The TREM or TREM fragment of embodiment 1000-1048, wherein the nucleotide corresponds to any of nucleotides 1-76 of SEQ ID NO: 622 is modified.

1050. The TREM or TREM fragment of any of embodiment 1048-1049, wherein the nucleotide is in the ASt Domain1.

1051. The TREM or TREM fragment of any of embodiment 1048-1049, wherein the nucleotide is in the DH Domain.

1052. The TREM or TREM fragment of any of embodiment 1048-1049, wherein the nucleotide is in the ACH Domain.

1053. The TREM or TREM fragment of any of embodiment 1048-1049, wherein the nucleotide is in the VL Domain.

1054. The TREM or TREM fragment of any of embodiment 1048-1049, wherein the nucleotide is in the TH Domain.

1055. The TREM or TREM fragment of any of embodiment 1048-1049, wherein the nucleotide is in the ASt Domain2.

1056. The TREM or TREM fragment of any of embodiment 1048-1049, wherein the nucleotide is in a linker domain (e.g., [L1], [L2], [L3], or [LA]).

1057. The TREM or TREM fragment of any of embodiment 1048-1056, wherein the nucleotide corresponding to any one of nucleotides 1, 2, 4, 6, 10, 12, 13, 17, 18, 20, 22, 29, 30, 42, 43, 45, 50, 52, 56, 59, 61, 65, 66, 68, 69, 71, 72, and 73 of SEQ ID NO: 622 is modified (e.g., a sequence in Table 15).

1058. The TREM or TREM fragment of any of embodiment 1000-1047, comprising a nucleotide comprising a nucleotide that lacks a non-naturally occurring modification, e.g., lacks a 2' OMe modification on a sugar moiety.

1059. The TREM or TREM fragment of embodiment 1058, wherein the nucleotide corresponds to any of nucleotides 1-76 of SEQ ID NO: 622 lacks a non-naturally occurring modification, e.g., lacks a 2' OMe modification on a sugar moiety.

1060. The TREM or TREM fragment of any of embodiment 1058-1059, wherein the nucleotide is in the ASt Domain1.

1061. The TREM or TREM fragment of any of embodiment 1058-1059, wherein the nucleotide is in the DH Domain.

1062. The TREM or TREM fragment of any of embodiment 1058-1059, wherein the nucleotide is in the ACH Domain.

1063 The TREM or TREM fragment of any of embodiment 1058-1059, wherein the nucleotide is in the VL Domain.

1064. The TREM or TREM fragment of any of embodiment 1058-1059, wherein the nucleotide is in the TH Domain.

1065. The TREM or TREM fragment of any of embodiment 1058-1059, wherein the nucleotide is in the ASt Domain2.

1066. The TREM or TREM fragment of any of embodiment 1058-1059, wherein the nucleotide is in a linker domain (e.g., [L1], [L2], [L3], or [L4]).

1067. The TREM or TREM fragment of any of embodiment 1000-1066, comprising a nucleotide comprising a 2' halo, e.g., a 2' fluoro, non-naturally occurring modification on a sugar moiety.

1068. The TREM or TREM fragment of embodiment 1067, wherein the 2' halo is 2' fluoro.

1069. The TREM or TREM fragment of embodiment 1067-1068, wherein the nucleotide corresponding to any of nucleotides 1-76 of SEQ ID NO: 622 is modified.

1070. The TREM or TREM fragment of embodiment 1067-1068, wherein the nucleotide is in the ASt Domain1.

1071. The TREM or TREM fragment of embodiment 1067-1068, wherein the nucleotide is in the DH Domain.

1072. The TREM or TREM fragment of embodiment 1067-1068, wherein the nucleotide is in the ACH Domain.

1073. The TREM or TREM fragment of embodiment 1067-1068, wherein the nucleotide is in the VL Domain.

1074. The TREM or TREM fragment of embodiment 1067-1068, wherein the nucleotide is in the TH Domain.

1075. The TREM or TREM fragment of embodiment 1067-1068, wherein the nucleotide is in the ASt Domain2.

1076. The TREM or TREM fragment of any of embodiment 1067-1068, wherein the nucleotide is in a linker domain (e.g., [L1], [L2], [L3], or [LA]).

1077. The TREM or TREM fragment of any of embodiment 1067-1076, wherein the nucleotide corresponding to any one of nucleotides 20, 29, 33, 40, 41, 44, 45, 48, 49, 50, 52, 53, 54, 56, 59, 61, 62, 63, 65, 67, 68, 69, 71, 72, 75, and 76 of SEQ ID NO: 622 is modified.

1078. The TREM or TREM fragment of any of embodiment 1000-1035, comprising a nucleotide that lacks a non-naturally occurring modification, e.g., lacks a 2' halo, e.g., a 2' fluoro, non-naturally occurring modification on a sugar moiety.

1079. The TREM or TREM fragment of embodiment 1078, wherein 2' halo is 2' fluoro.

1080. The TREM or TREM fragment of any of embodiments 1078-1079, wherein the nucleotide corresponds to any of nucleotides 1-76 of SEQ ID NO: 622 and lacks a non-naturally occurring modification.

1081. The TREM or TREM fragment of any of embodiments 1078-1079, wherein the nucleotide is in the ASt Domain1.

1082. The TREM or TREM fragment of any of embodiments 1078-1079, wherein the nucleotide is in the DH Domain.

1083. The TREM or TREM fragment of any of embodiments 1078-1079, wherein the nucleotide is in the ACH Domain.

1084. The TREM or TREM fragment of any of embodiments 1078-1079, wherein the nucleotide is in the VL Domain.

1085. The TREM or TREM fragment of any of embodiments 1078-1079, wherein the nucleotide is in the TH Domain.

1086. The TREM or TREM fragment of any of embodiments 1078-1079, wherein the nucleotide is in the ASt Domain2.

1087. The TREM or TREM fragment of any of embodiments 1078-1079, wherein the nucleotide is in a linker domain (e.g., [L1], [L2], [L3], or [LA]).

1088. The TREM or TREM fragment of any of embodiment 1000-1013, wherein the nucleotide corresponding to any one of nucleotides 20, 29, 33, 40, 41, 44, 45, 48, 49, 50, 52, 53, 54, 56, 59, 61, 62, 63, 67, 68, 69, 71, 72, 75, and 76 of SEQ ID NO: 622 lacks a non-naturally occurring modification, e.g., a 2' fluoro non-naturally occurring modification on the sugar.

1089. The TREM or TREM fragment of any of embodiments 1000-1088, wherein the non-naturally occurring modification comprises a 2' deoxy nucleotide.

1090. The TREM or TREM fragment of embodiment 1084, wherein the 2' deoxy nucleotide corresponds to any of nucleotides 1-76 of SEQ ID NO: 622 is modified.

1091. The TREM or TREM fragment of any of embodiments 1089-1090, wherein the 2' deoxy nucleotide is in the ASt Domain1.

1092. The TREM or TREM fragment of any of embodiments 1089-1090, wherein the 2' deoxy nucleotide is in the DH Domain.

1093. The TREM or TREM fragment of any of embodiments 1089-1090, wherein the 2' deoxy nucleotide is in the ACH Domain.

1094. The TREM or TREM fragment of any of embodiments 1089-1090, wherein the 2' deoxy nucleotide is in the VL Domain.

1095. The TREM or TREM fragment of any of embodiments 1089-1090, wherein the 2' deoxy nucleotide is in the TH Domain.

1096. The TREM or TREM fragment of any of embodiments 1089-1090, wherein the 2' deoxy nucleotide is in the ASt Domain2.

1097. The TREM or TREM fragment of any of embodiments 1089-1090, wherein the nucleotide is in a linker domain (e.g., [L1], [L2], [L3], or [LA]).

1098. The TREM or TREM fragment of any of embodiments 1089-1090, wherein the nucleotide corresponding to any one of nucleotides 3, 4, 5, 6, 14, 15, 16, 20, 22, 23, 33, 54, 59, 62, 63, 72, and 76 of SEQ ID NO: 622 is a 2' deoxy nucleotide.

1099. The TREM or TREM fragment of any of embodiments 1000-1092, comprising an 2'-OH nucleotide.

1100. The TREM or TREM fragment of embodiment 1099, wherein the 2'-OH nucleotide corresponds to any of nucleotides 1-76 of SEQ ID NO:622.

1101. The TREM or TREM fragment of any of embodiments 1099-1100, wherein the nucleotide is in the ASt Domain1.

1102. The TREM or TREM fragment of any of embodiments 1099-1100, wherein the nucleotide is in the DH Domain.

1103. The TREM or TREM fragment of any of embodiments 1099-1100, wherein the nucleotide is in the ACH Domain.

1104. The TREM or TREM fragment of any of embodiments 1099-1100, wherein the nucleotide is in the VL Domain.

1105. The TREM or TREM fragment of any of embodiments 1099-1100, wherein the nucleotide is in the TH Domain.

1106. The TREM or TREM fragment of any of embodiments 1099-1100, wherein the nucleotide is in the ASt Domain2.

1107. The TREM or TREM fragment of any of embodiments 1099-1100, wherein the nucleotide is in a linker domain (e.g., [L1], [L2], [L3], or [L4]).

1109. The TREM or TREM fragment of any of embodiment 1000-1100, wherein the nucleotide corresponding to any one of nucleotides 3, 4, 5, 6, 14, 15, 16, 20, 22, 23, 33, 54, 59, 62, 63, 72, and 76 of SEQ ID NO: 622 is a 2'-OH nucleotide.

1110. The TREM or TREM fragment of any of embodiments 1000-1109, wherein the non-naturally occurring modification comprises a 2' methoxyethyl (MOE) nucleotide.

1111. The TREM or TREM fragment of embodiment 1110, wherein the nucleotide corresponds to any of nucleotides 1-76 of SEQ ID NO: 622.

1112. The TREM or TREM fragment of any of embodiments 1110-1111, wherein the 2'-MOE nucleotide is in the ASt Domain1.

1113. The TREM or TREM fragment of any of embodiments 1110-1111, wherein the 2'-MOE nucleotide is in the DH Domain.

1114. The TREM or TREM fragment of any of embodiments 1110-1111, wherein the 2'-MOE nucleotide is in the ACH Domain.

1115. The TREM or TREM fragment of any of embodiments 1110-1111, wherein the 2'-MOE nucleotide is in the VL Domain.

1116. The TREM or TREM fragment of any of embodiments 1110-1111, wherein the 2'-MOE nucleotide is in the TH Domain.

1117. The TREM or TREM fragment of any of embodiments 1110-1111, wherein the 2'-MOE nucleotide is in the ASt Domain2.

1118. The TREM or TREM fragment of any of embodiments 1110-1111, wherein the 2'-MOE nucleotide is in a linker domain (e.g., [L1], [L2], [L3], or [L4]).

1119. The TREM or TREM fragment of any of embodiments 1110-1118, wherein the nucleotide corresponding to any one of nucleotides 1, 4, 14, 15, 16, 17, 20, 29, 44, 45, 47, 49, 50, 52, 54, 56, 57, 59, 65, 72, and 73 of SEQ ID NO: 622 is a 2'-MOE nucleotide.

1120. The TREM or TREM fragment of any of embodiments 1000-1109, comprising a nucleotide that lacks a non-naturally occurring modification, e.g., lacks a 2-MOE, e.g., a non-naturally occurring modification on a sugar moiety.

1121. The TREM or TREM fragment of embodiment 1120, wherein the nucleotide corresponds to any of nucleotides 1-76 of SEQ ID NO: 622 and lacks a non-naturally occurring modification.

1122. The TREM or TREM fragment of any of embodiments 1120-1121, wherein the nucleotide is in the ASt Domain1.

1123. The TREM or TREM fragment of any of embodiments 1120-1121, wherein the nucleotide is in the DH Domain.

1124. The TREM or TREM fragment of any of embodiments 1120-1121, wherein the nucleotide is in the ACH Domain.

1125. The TREM or TREM fragment of any of embodiments 1120-1121, wherein the nucleotide is in the VL Domain.

1126. The TREM or TREM fragment of any of embodiments 1120-1121, wherein the nucleotide is in the TH Domain.

1127. The TREM or TREM fragment of any of embodiments 1120-1121, wherein the nucleotide is in the ASt Domain2.

1128. The TREM or TREM fragment of any of embodiments 1120-1121, wherein the nucleotide is in a linker domain (e.g., [L1], [L2], [L3], or [L4]).

1129. The TREM or TREM fragment of any of embodiments 1120-1128, wherein the nucleotide corresponding to any one of nucleotides 1, 4, 14, 15, 16, 17, 20, 29, 44, 45, 47, 49, 50, 52, 54, 56, 57, 59, 65, 72, and 73 of SEQ ID NO: 622 and lacks a 2'-MOE nucleotide.

1130. The TREM or TREM fragment of any of embodiment 1000-1129, comprising a modified backbone, e.g., a modification of the phosphate moiety attached to the 5' or 3' carbon of the sugar moiety of a nucleotide.

1131. The TREM or TREM fragment of embodiment 1130, wherein the phosphate moiety attached to the 5' carbon is modified.

1132. The TREM or TREM fragment of embodiment 1130, wherein the phosphate moiety attached to the 3' carbon is modified.

1133. The TREM or TREM fragment of embodiment 1130, wherein the modification comprises a phosphothioate moiety.

1134. The TREM or TREM fragment of embodiments 1130-1133, wherein the nucleotide corresponds to any of nucleotides 1-76 of SEQ ID NO: 622 is modified.

1135. The TREM or TREM fragment of embodiments 1130-1133, wherein the modified nucleotide is in the ASt Domain1.

1136. The TREM or TREM fragment of embodiments 1130-1133, wherein the modified nucleotide is in the DH Domain.

1137. The TREM or TREM fragment of embodiments 1130-1133, wherein the modified nucleotide is in the ACH Domain.

1138. The TREM or TREM fragment of embodiments 1130-1133, wherein the modified nucleotide is in the VL Domain.

1139. The TREM or TREM fragment of embodiments 1130-1133, wherein the modified nucleotide is in the TH Domain.

1140. The TREM or TREM fragment of embodiments 1130-1133, wherein the modified nucleotide is in the ASt Domain2.

1141. The TREM or TREM fragment of any of embodiments 1130-1133, wherein the nucleotide is in a linker domain (e.g., [L1], [L2], [L3], or [L4]).

1142. The TREM or TREM fragment of embodiments 1130-1133, wherein the nucleotide corresponding to any one of nucleotides 1, 2, 3, 9, 14, 15, 16, 17, 18, 19, 20, 21, 35, 37, 38, 44, 45, 46, 52, 54, 55, 56, 57, 58, 73, and 74 of SEQ ID NO: 622 is backbone modified, e.g., with a phosphorothioate moiety.

1142. The TREM or TREM fragment of embodiments 1130-1141, wherein the nucleotide corresponding to any one of nucleotides 14, 15, 16, 17, 18, 20, 44, 45, 47, 54, 56, 57, and 59 of SEQ ID NO: 622 is backbone modified, e.g., with a phosphorothioate moiety.

1143. The TREM or TREM fragment of embodiments 1000-1142, lacking a backbone modification, e.g., a phosphorothioate moiety.

1144. The TREM or TREM fragment of embodiment 1143, wherein the nucleotide which is not backbone modified corresponds to any of nucleotides 1-76 of SEQ ID NO: 622.

1145. The TREM or TREM fragment of embodiment 1143, wherein the nucleotide which is not backbone modified is in the ASt Domain1.

1146. The TREM or TREM fragment of embodiment 1143, wherein the nucleotide which is not backbone modified is in the DH Domain.

1147. The TREM or TREM fragment of embodiment 1143, wherein the nucleotide which is not backbone modified is in the ACH Domain.

1148. The TREM or TREM fragment of embodiment 1143, wherein the nucleotide which is not backbone modified is in the VL Domain.

1149. The TREM or TREM fragment of embodiment 1143, wherein the nucleotide which is not backbone modified is in the TH Domain.

1150. The TREM or TREM fragment of embodiment 1143, wherein the nucleotide which is not backbone modified is in the ASt Domain2.

1151. The TREM or TREM fragment of embodiment 1143, wherein the nucleotide which is not backbone modified is in a linker domain (e.g., [L1], [L2], [L3], or [L4]).

1152. The TREM or TREM fragment of any of embodiments 1000-1151, wherein the nucleotide corresponding to any one of nucleotides 1, 2, 3, 9, 14, 15, 16, 17, 18, 19, 20, 21, 35, 37, 38, 44, 45, 46, 52, 54, 55, 56, 57, 58, 73, and 74 of SEQ ID NO: 622 is not backbone modified.

1153. The TREM or TREM fragment of any of embodiments 1000-1152, wherein a position corresponding to a modified position having a value of 3 for the 100 nm for the sequence in Table 15 is modified with a 2'-O Me.

1154. The TREM or TREM fragment of any of embodiments 1000-1152, wherein a position corresponding to a modified position having a value of 2 for the 100 nm for the sequence in Table 15 is modified with a 2'-O Me.

1155. The TREM or TREM fragment of any of embodiments 1000-1152, wherein a position corresponding to a modified position having a value of 1 for the 100 nm for the sequence in Table 15 is modified with a 2'-O Me.

1156. The TREM or TREM fragment of any of embodiments 1000-1152, wherein a position corresponding to a modified position having a value of 3 for the 100 nm for the sequence in Table 15 is not modified.

1157. The TREM or TREM fragment of any of embodiments 1000-1152, wherein a position corresponding to a modified position having a value of 2 for the 100 nm for the sequence in Table 15 is not modified.

1158. The TREM or TREM fragment of any of embodiments 1000-1152, wherein a position corresponding to a modified position having a value of 1 for the 100 nm for the sequence in Table 15 is not modified.

1159. The TREM or TREM fragment of any of embodiments 1000-1152, wherein a position corresponding to a modified position having a value of 3 for the 100 nm for the sequence in Table 21 is modified with a 2'-O Me.

1160. The TREM or TREM fragment of any of embodiments 1000-1152, wherein a position corresponding to a modified position having a value of 2 for the 100 nm for the sequence in Table 21 is modified with a 2'-O Me.

1161. The TREM or TREM fragment of any of embodiments 1000-1152, wherein a position corresponding to a modified position having a value of 1 for the 100 nm for the sequence in Table 21 is modified with a 2'-O Me.

1162. The TREM or TREM fragment of any of embodiments 1000-1152, wherein a position corresponding to a modified position having a value of 3 for the 100 nm for the sequence in Table 21 is not modified.

1163. The TREM or TREM fragment of any of embodiments 1000-1152, wherein a position corresponding to a modified position having a value of 2 for the 100 nm for the sequence in Table 21 is not modified.

1164. The TREM or TREM fragment of any of embodiments 1000-1152, wherein a position corresponding to a modified position having a value of 1 for the 100 nm for the sequence in Table 21 is not modified.

1165. The TREM or TREM fragment of any of embodiments 1000-1152, wherein a position corresponding to a modified position having a value of 3 for the 100 nm for the sequence in Table 22 is modified with a 2'-O Me.

1166. The TREM or TREM fragment of any of embodiments 1000-1152, wherein a position corresponding to a modified position having a value of 2 for the 100 nm for the sequence in Table 22 is modified with a 2'-O Me.

1167. The TREM or TREM fragment of any of embodiments 1000-1152, wherein a position corresponding to a modified position having a value of 1 for the 100 nm for the sequence in Table 22 is modified with a 2'-O Me.

1168. The TREM or TREM fragment of any of embodiments 1000-1152, wherein a position corresponding to a modified position having a value of 3 for the 100 nm for the sequence in Table 22 is not modified.

1169. The TREM or TREM fragment of any of embodiments 1000-1152, wherein a position corresponding to a modified position having a value of 2 for the 100 nm for the sequence in Table 22 is not modified.

1170. The TREM or TREM fragment of any of embodiments 1000-1152, wherein a position corresponding to a modified position having a value of 1 for the 100 nm for the sequence in Table 22 is not modified.

1171 The TREM or TREM fragment of any of embodiments 1000-1152, wherein a position corresponding to a modified position having a value of 3 for the 100 nm for the sequence in Table 17 is modified with a 2'-MOE.

1172. The TREM or TREM fragment of any of embodiments 1000-1152, wherein a position corresponding to a modified position having a value of 2 for the 100 nm for the sequence in Table 17 is modified with a 2'-MOE.

1173. The TREM or TREM fragment of any of embodiments 1000-1152, wherein a position corresponding to a modified position having a value of 1 for the 100 nm for the sequence in Table 17 is modified with a 2'-MOE.

1174. The TREM or TREM fragment of any of embodiments 1000-1152, wherein a position corresponding to a modified position having a value of 3 for the 100 nm for the sequence in Table 17 is not modified.

1175. The TREM or TREM fragment of any of embodiments 1000-1152, wherein a position corresponding to a modified position having a value of 2 for the 100 nm for the sequence in Table 17 is not modified.

1176. The TREM or TREM fragment of any of embodiments 1000-1152, wherein a position corresponding to a modified position having a value of 1 for the 100 nm for the sequence in Table 17 is not modified.

1177. The TREM or TREM fragment of any of embodiments 1000-1152, wherein a position corresponding to a modified position having a value of 3 for the 100 nm for the sequence in Table 16 is modified with a 2'-fluoro.

1178. The TREM or TREM fragment of any of embodiments 1000-1152, wherein a position corresponding to a modified position having a value of 2 for the 100 nm for the sequence in Table 16 is modified with a 2'-fluoro.

1179. The TREM or TREM fragment of any of embodiments 1000-1152, wherein a position corresponding to a modified position having a value of 1 for the 100 nm for the sequence in Table 16 is modified with a 2'-fluoro.

1180. The TREM or TREM fragment of any of embodiments 1000-1152, wherein a position corresponding to a modified position having a value of 3 for the 100 nm for the sequence in Table 16 is not modified.

1181. The TREM or TREM fragment of any of embodiments 1000-1152, wherein a position corresponding to a modified position having a value of 2 for the 100 nm for the sequence in Table 16 is not modified.

1182. The TREM or TREM fragment of any of embodiments 1000-1152, wherein a position corresponding to a modified position having a value of 1 for the 100 nm for the sequence in Table 16 is not modified.

1183. The TREM or TREM fragment of any of embodiments 1000-1152, wherein a position corresponding to a modified position having a value of 3 for the 100 nm for the sequence in Table 18 is modified to be a 2'-deoxy.

1184. The TREM or TREM fragment of any of embodiments 1000-1152, wherein a position corresponding to a modified position having a value of 2 for the 100 nm for the sequence in Table 18 is modified to be a 2'-deoxy.

1185. The TREM or TREM fragment of any of embodiments 1000-1152, wherein a position corresponding to a modified position having a value of 1 for the 100 nm for the sequence in Table 18 is modified to be a 2'-deoxy.

1186. The TREM or TREM fragment of any of embodiments 1000-1152, wherein a position corresponding to a modified position having a value of 3 for the 100 nm for the sequence in Table 18 is not modified.

1187. The TREM or TREM fragment of any of embodiments 1000-1152, wherein a position corresponding to a modified position having a value of 2 for the 100 nm for the sequence in Table 18 is not modified.

1188. The TREM or TREM fragment of any of embodiments 1000-1152, wherein a position corresponding to a modified position having a value of 1 for the 100 nm for the sequence in Table 18 is not modified.

1189. The TREM or TREM fragment of any of embodiments 1000-1152, wherein a position corresponding to a modified position having a value of 3 for the 100 nm for the sequence in Table 19 comprises a phosphorothate.

1190. The TREM or TREM fragment of any of embodiments 1000-1152, wherein a position corresponding to a modified position having a value of 2 for the 100 nm for the sequence in Table 19 comprises a phosphorothate.

1191. The TREM or TREM fragment of any of embodiments 1000-1152, wherein a position corresponding to a modified position having a value of 1 for the 100 nm for the sequence in Table 19 comprises a phosphorothate.

1192. The TREM or TREM fragment of any of embodiments 1000-1152, wherein a position corresponding to a modified position having a value of 3 for the 100 nm for the sequence in Table 19 is not modified.

1193. The TREM or TREM fragment of any of embodiments 1000-1152, wherein a position corresponding to a modified position having a value of 2 for the 100 nm for the sequence in Table 19 is not modified.

1194. The TREM or TREM fragment of any of embodiments 1000-1152, wherein a position corresponding to a modified position having a value of 1 for the 100 nm for the sequence in Table 19 is not modified.

1195. The TREM or TREM fragment of any of embodiments 1000-1152, wherein the TREM comprises an anticodon specific for an amino acid from Table 1.

1196. The TREM or TREM fragment of any of embodiments 1000-1152, wherein the TREM comprises an anticodon of Table 1.

1197. The TREM or TREM fragment of any of embodiments 1000-1196, comprising a first and a second non-naturally occurring modification.

1198. The TREM or TREM fragment of embodiment 1197, comprising a third non-naturally occurring modification.

1199. The or TREM fragment of any of embodiments 1197-1198, comprising, wherein the first and second non-naturally occurring modifications are the same non-naturally occurring modification.

1200. The TREM or TREM fragment of any of embodiments 1197-1198, comprising wherein the first and second non-naturally occurring modifications are different non-naturally occurring modifications.

1201. The TREM or TREM fragment of any of embodiments 1197-1198, comprising wherein the first and second non-naturally occurring modification are on the same nucleotide.

1202. The TREM or TREM fragment of any of embodiments 1197-1198, wherein the first and second non-naturally occurring modification are on the different nucleotides.

1203. The TREM or TREM fragment of any of embodiments 1197-1198, wherein the first and second non-naturally occurring modifications are in the same domain.

1204. The TREM or TREM fragment of any of embodiments 1197-1198, wherein the first and second non-naturally occurring modifications are in different domains.

1205. The TREM or TREM fragment of any one the preceding embodiments, wherein the domain comprising the non-naturally occurring modification has a function, e.g., a domain function described herein.

1206. The TREM or TREM fragment of any of the preceding embodiments, wherein the TREM has at least X % sequence identity with a sequence described herein, e.g., with SEQ ID NO: 622, SEQ ID NO: 993, or SEQ ID NO: 1079, or a consensus sequence disclosed herein, e.g., from Table 9 or 10, wherein x=60, 70, 75, 80, 85, 90, or 95.

1207. The TREM or TREM fragment of embodiment 1206, wherein x=60.

1208. The TREM or TREM fragment of embodiment 1206, wherein x=70.

1209. The TREM or TREM fragment of embodiment 1206, wherein x=75.

1210. The TREM or TREM fragment of embodiment 1206, wherein x=80.

1211. The TREM or TREM fragment of embodiment 1206, wherein x=85.

1212. The TREM or TREM fragment of embodiment 1206, wherein x=90.

1213. The TREM or TREM fragment of embodiment 1206, wherein x=95.

1214. The TREM or TREM fragment of any of embodiments 1001-1213, having a modified nucleotide at a position corresponding to a position that is modified in a row of any of Tables 15-22.

1215. The TREM or TREM fragment of any of embodiments 1001-1213, having a modified nucleotide at a position corresponding to a position that is modified in a row of Table 15.

1216. The TREM or TREM fragment of any of embodiments 1001-1213, having a modified nucleotide at a position corresponding to a position that is modified in a row of Table 16.

1217. The TREM or TREM fragment of any of embodiments 1001-1213, having a modified nucleotide at a position corresponding to a position that is modified in a row of Table 17.

1218. The TREM or TREM fragment of any of embodiments 1001-1213, having a modified nucleotide at a position corresponding to a position that is modified in a row of Table 18.

1219. The TREM or TREM fragment of any of embodiments 1001-1213, having a modified nucleotide at a position corresponding to a position that is modified in a row of Table 19.

1220. The TREM or TREM fragment of any of embodiments 1001-1213, having a modified nucleotide at a position corresponding to a position that is modified in a row of Table 20.

1221. The TREM or TREM fragment of any of embodiments 1001-1213, having a modified nucleotide at a position corresponding to a position that is modified in a row of Table 21.

1222. The TREM or TREM fragment of any of embodiments 1001-1213, having a modified nucleotide at a position corresponding to a position that is modified in a row of Table 22.

1223. The TREM or TREM fragment of any of embodiments 1001-1213, having a modified nucleotide at a first and a modified nucleotide at a second position, wherein the first and second positions correspond to positions that are modified in any one row of Table 22.

1224. A pharmaceutical composition comprising a TREM or TREM fragment of any of the preceding embodiments.

1225. The pharmaceutical composition of embodiment 1224, comprising a pharmaceutically acceptable component, e.g., an excipient.

1226. A lipid nanoparticle formulation comprising a TREM or TREM fragment of any one of embodiments 1000-1213, or a pharmaceutical composition of any one of embodiments 1224-1225.

1227. A method of making a TREM or TREM fragment of any of embodiments 1000-1213, comprising linking a first nucleotide to a second nucleotide to form the TREM or TREM fragment.

1228. The method of embodiment 1227, wherein the TREM or TREM fragment is non-naturally occurring (e.g., synthetic).

1229. The method of embodiment 1227, wherein the synthesis is performed in vitro.

1230. The method of embodiment 1227, wherein the TREM or TREM fragment is made by cell-free solid phase synthesis.

1231. A cell comprising a TREM or TREM fragment of any of embodiments 1000-1213.

1232. A method of modulating a tRNA pool in a cell comprising:
providing a TREM or TREM fragment of any of embodiments 1000-1213, and
contacting the cell with the TREM,
thereby modulating the tRNA pool in the cell.

1233. A method of contacting a cell, tissue, or subject with a TREM or TREM fragment of any of embodiments 1000-1213, comprising contacting the cell, tissue or subject with the TREM, thereby contacting the cell, tissue, or subject with the TREM.

1234. A method of presenting a TREM or TREM fragment, to a cell, tissue, or subject, comprising
contacting the cell, tissue or subject with a TREM or TREM fragment of any of embodiments 1000-1213,
thereby presenting the TREM, TREM core fragment or TREM fragment to a cell, tissue, or subject.

1235. A method of forming a TREM-contacted cell, tissue, or subject, comprising:
contacting the cell, tissue or subject with a TREM or TREM fragment of any of embodiments 1000-1213, thereby forming a TREM-contacted cell, tissue, or subject.

1236. A method of using a TREM comprising,
contacting a cell, tissue or subject with a TREM or TREM fragment of any of embodiments 1000-1213, thereby using the TREM.

1237. A method of applying a TREM to a cell, tissue, or subject, comprising
contacting the cell, tissue or subject with a TREM or TREM fragment of any of embodiments 1000-1213, thereby applying a TREM to a cell, tissue, or subject.

1238. A method of exposing a cell, tissue, or subject to a TREM, comprising
contacting the cell, tissue or subject with a TREM or TREM fragment of any of embodiments 1000-1213, thereby exposing a cell, tissue, or subject to a TREM.

1239. A method of forming an admixture of a TREM, and a cell, tissue, or subject, comprising
contacting the cell, tissue or subject with a TREM or TREM fragment of any of embodiments 1000-1213, thereby forming an admixture of a TREM and a cell, tissue, or subject.

1240. A method of delivering a TREM to a cell, tissue, or subject, comprising:
providing a cell, tissue, or subject, and contacting the cell, tissue, or subject, a TREM or TREM fragment of any of embodiments 1000-1213.

1241. A method, e.g., an ex vivo method, of modulating the metabolism, e.g., the translational capacity of an organelle, comprising:
providing a preparation of an organelle, e.g., mitochondria or chloroplasts, and contacting the organelle with a TREM or TREM fragment of any of embodiments 1000-1213.

1242. A method of treating a subject, e.g., modulating the metabolism, e.g., the translational capacity of a cell, in a subject, comprising:
providing, e.g., administering to the subject a TREM or TREM fragment of any of embodiments 1000-1213, thereby treating the subject.

1243. A method of modulating a tRNA pool in a cell comprising an endogenous open reading frame (ORF), which ORF comprises a codon having a first sequence, comprising:

optionally, acquiring knowledge of the abundance of one or both of (i) and (ii), e.g., acquiring knowledge of the relative amounts of: (i) and (ii) in the cell, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the cell;

contacting the cell with a TREM or TREM fragment of any of embodiments 1000-1213, wherein the TREM has an anticodon that pairs with: the codon having the first sequence; or the codon other than the codon having the first sequence, in an amount and/or for a time sufficient to modulate the relative amounts of the first tRNA moiety and the second tRNA moiety in the cell, thereby modulating the tRNA pool in the cell.

1244. A method of modulating a tRNA pool in a subject having an endogenous open reading frame (ORF), which ORF comprises a codon having a first sequence, comprising:

optionally, acquiring knowledge of the abundance of one or both of (i) and (ii), e.g., acquiring knowledge of the relative amounts of: (i) and (ii) in the subject, wherein (i) is a tRNA moiety having an anticodon that pairs with the codon of the ORF having a first sequence (the first tRNA moiety) and (ii) is an isoacceptor tRNA moiety having an anticodon that pairs with a codon other than the codon having the first sequence (the second tRNA moiety) in the subject;

contacting the subject with a TREM or TREM fragment of any of embodiments 1000-1213, wherein the TREM has an anticodon that pairs with: the codon having the first sequence; or the codon other than the codon having the first sequence, in an amount and/or for a time sufficient to modulate the relative amounts of the first tRNA moiety and the second tRNA moiety in the subject, thereby modulating the tRNA pool in the subject.

1245. A method of modulating a tRNA pool in a subject having an endogenous open reading frame (ORF) comprising a codon comprising a synonymous mutation (a synonymous mutation codon or SMC), comprising:

providing a composition comprising a TREM or TREM fragment of any of embodiments 1000-1213, wherein the TREM comprises an isoacceptor tRNA moiety comprising an anticodon sequence that pairs with the SMC (the TREM);

contacting the subject with the composition in an amount and/or for a time sufficient to modulate the tRNA pool in the subject, thereby modulating the tRNA pool in the subject.

1246. A method of modulating a tRNA pool in a cell comprising an endogenous open reading frame (ORF) comprising a codon comprising a synonymous mutation (a synonymous mutation codon or SMC), comprising:

providing a composition comprising a TREM or TREM fragment of any of embodiments 1000-1213, wherein the TREM comprises an isoacceptor tRNA moiety comprising an anticodon sequence that pairs with the SMC (the TREM);

contacting the cell with the composition comprising a TREM in an amount and/or for a time sufficient to modulate the tRNA pool in the cell, thereby modulating the tRNA pool in the cell.

1247. A method of modulating expression of a protein in a cell, wherein the protein is encoded by a nucleic acid comprising an endogenous open reading frame (ORF), which ORF comprises a codon having a mutation, comprising:

contacting the cell with a composition comprising a TREM or TREM fragment of any of embodiments 1000-1213, in an amount and/or for a time sufficient to modulate expression of the encoded protein, wherein the TREM has an anticodon that pairs with the codon having the mutation, thereby modulating expression of the protein in the cell.

1248. A method of modulating expression of a protein in a subject, wherein the protein is encoded by a nucleic acid comprising an endogenous open reading frame (ORF), which ORF comprises a codon having a mutation, comprising:

contacting the subject with a composition comprising a TREM or TREM fragment of any of embodiments 1000-1213, in an amount and/or for a time sufficient to modulate expression of the encoded protein, wherein the TREM has an anticodon that pairs with the codon having the mutation, thereby modulating expression of the protein in the subject.

1249. The method of embodiment 1247 or 1248, wherein the mutation in the ORF is a nonsense mutation, e.g., resulting in a premature stop codon chosen from UAA, UGA or UAG.

1250. The method of embodiment 1247 or 1248, wherein the TREM comprises an anticodon that pairs with a stop codon.

Other features, objects, and advantages of the invention will be apparent from the description and from the claims.

Unless otherwise defined, all technical and scientific terms used herein have the same meaning as commonly understood by one of ordinary skill in the art to which this invention belongs. All publications, patent applications, patents, and other references mentioned herein are incorporated by reference in their entirety. In addition, the materials, methods, and examples are illustrative only and not intended to be limiting.

DETAILED DESCRIPTION OF CERTAIN EMBODIMENTS

The present disclosure features tRNA-based effector molecules (TREMs) comprising a non-naturally occurring modification and methods relating thereto. As disclosed herein, TREMs are complex molecules which can mediate a variety of cellular processes. Pharmaceutical TREM compositions, e.g., TREMs comprising a non-naturally occurring modification, can be administered to a cell, a tissue, or to a subject to modulate these functions.

Definitions

A "nucleotide," as that term is used herein, refers to an entity comprising a sugar, typically a pentameric sugar; a nucleobase; and a phosphate linking group. In an embodiment, a nucleotide comprises a naturally occurring, e.g., naturally occurring in a human cell, nucleotide, e.g., an adenine, thymine, guanine, cytosine, or uracil nucleotide.

A "modification," as that term is used herein with reference to a nucleotide, refers to a modification of the chemical structure, e.g., a covalent modification, of the subject nucleotide. The modification can be naturally occurring or non-naturally occurring. In an embodiment, the modification is non-naturally occurring. In an embodiment, the modification is naturally occurring. In an embodiment, the modification is a synthetic modification. In an embodiment, the modification is a modification provided in Tables 5, 6, 7, 8 or 9.

A "non-naturally occurring modification," as that term is used herein with reference to a nucleotide, refers to a modification that: (a) a cell, e.g., a human cell, does not make on an endogenous tRNA; or (b) a cell, e.g., a human cell, can make on an endogenous tRNA but wherein such modification is in a location in which it does not occur on a native tRNA, e.g., the modification is in a domain, linker or arm, or on a nucleotide and/or at a position within a domain, linker or arm, which does not have such modification in nature. In either case, the modification is added synthetically, e.g., in a cell free reaction, e.g., in a solid state or liquid phase synthetic reaction. In an embodiment, the non-naturally occurring modification is a modification that is not present (in identity, location or position) if a sequence of the TREM is expressed in a mammalian cell, e.g., a HEK293 cell line. Exemplary non-naturally occurring modifications are found in Tables 5, 6, 7, 8 or 9.

A "non-naturally modified nucleotide," as that term is used herein, refers a nucleotide comprising a non-naturally occurring modification on or of a sugar, nucleobase, or phosphate moiety.

A "naturally occurring nucleotide," as that term is used herein, refers to a nucleotide that does not comprise a non-naturally occurring modification. In an embodiment, it includes a naturally occurring modification.

A "tRNA-based effector molecule" or "TREM," as that term is used herein, refers to an RNA molecule comprising a structure or property from (a)-(v) below, and which is a recombinant TREM, a synthetic TREM, or a TREM expressed from a heterologous cell. The TREMs described in the present invention are synthetic molecules and are made, e.g., in a cell free reaction, e.g., in a solid state or liquid phase synthetic reaction. TREMs are chemically distinct, e.g., in terms of primary sequence, type or location of modifications from the endogenous tRNA molecules made in cells, e.g., in mammalian cells, e.g., in human cells. A TREM can have a plurality (e.g., 2, 3, 4, 5, 6, 7, 8, 9) of the structures and functions of (a)-(v).

In an embodiment, a TREM is non-native, as evaluated by structure or the way in which it was made.

In an embodiment, a TREM comprises one or more of the following structures or properties:

(a') an optional linker region of a consensus sequence provided in the "Consensus Sequence" section, e.g., a Linker 1 region;

(a) an amino acid attachment domain that binds an amino acid, e.g., an acceptor stem domain (AStD), wherein an AStD comprises sufficient RNA sequence to mediate, e.g., when present in an otherwise wildtype tRNA, acceptance of an amino acid, e.g., its cognate amino acid or a non-cognate amino acid, and transfer of the amino acid (AA) in the initiation or elongation of a polypeptide chain. Typically, the AStD comprises a 3'-end adenosine (CCA) for acceptor stem charging which is part of synthetase recognition. In an embodiment the AStD has at least 75, 80, 85, 85, 90, 95, or 100% identity with a naturally occurring AStD, e.g., an AStD encoded by a nucleic acid in Table 1. In an embodiment, the TREM can comprise a fragment or analog of an AStD, e.g., an AStD encoded by a nucleic acid in Table 1, which fragment in embodiments has AStD activity and in other embodiments does not have AStD activity. (One of ordinary skill can determine the relevant corresponding sequence for any of the domains, stems, loops, or other sequence features mentioned herein from a sequence encoded by a nucleic acid in Table 1. E.g., one of ordinary skill can determine the sequence which corresponds to an AStD from a tRNA sequence encoded by a nucleic acid in Table 1.)

In an embodiment the AStD falls under the corresponding sequence of a consensus sequence provided in the "Consensus Sequence" section, or differs from the consensus sequence by no more than 1, 2, 5, or 10 positions;

In an embodiment, the AStD comprises residues $R_1$-$R_2$-$R_3$-$R_4$-$R_5$-$R_6$-$R_7$ and residues $R_{65}$-$R_{66}$-$R_{67}$-$R_{68}$-$R_{69}$-$R_{70}$-$R_{71}$ of Formula I zzz, wherein ZZZ indicates any of the twenty amino acids;

In an embodiment, the AStD comprises residues $R_1$-$R_2$-$R_3$-$R_4$-$R_5$-$R_6$-$R_7$ and residues $R_{65}$-$R_{66}$-$R_{67}$-$R_{68}$-$R_{69}$-$R_{70}$-$R_{71}$ of Formula II zzz, wherein ZZZ indicates any of the twenty amino acids;

In an embodiment, the AStD comprises residues $R_1$-$R_2$-$R_3$-$R_4$-$R_5$-$R_6$-$R_7$ and residues $R_{65}$-$R_{66}$-$R_{67}$-$R_{68}$-$R_{69}$-$R_{70}$-$R_{71}$ of Formula III zzz, wherein ZZZ indicates any of the twenty amino acids;

(a'-1) a linker comprising residues $R_8$-$R_9$ of a consensus sequence provided in the "Consensus Sequence" section, e.g., a Linker 2 region;

(b) a dihydrouridine hairpin domain (DHD), wherein a DHD comprises sufficient RNA sequence to mediate, e.g., when present in an otherwise wildtype tRNA, recognition of aminoacyl-tRNA synthetase, e.g., acts as a recognition site for aminoacyl-tRNA synthetase for amino acid charging of the TREM. In embodiments, a DHD mediates the stabilization of the TREM's tertiary structure. In an embodiment the DHD has at least 75, 80, 85, 85, 90, 95, or 100% identity with a naturally occurring DHD, e.g., a DHD encoded by a nucleic acid in Table 1. In an embodiment, the TREM can comprise a fragment or analog of a DHD, e.g., a DHD encoded by a nucleic acid in Table 1, which fragment in embodiments has DHD activity and in other embodiments does not have DHD activity.

In an embodiment the DHD falls under the corresponding sequence of a consensus sequence provided in the "Consensus Sequence" section, or differs from the consensus sequence by no more than 1, 2, 5, or 10 positions;

In an embodiment, the DHD comprises residues $R_{10}$-$R_{11}$-$R_{12}$-$R_{13}$-$R_{14}$ $R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$ of Formula I$_{ZZZ}$, wherein ZZZ indicates any of the twenty amino acids;

In an embodiment, the DHD comprises residues $R_{10}$-$R_{11}$-$R_{12}$-$R_{13}$-$R_{14}$ $R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$ of Formula II$_{ZZZ}$, wherein ZZZ indicates any of the twenty amino acids;

In an embodiment, the DHD comprises residues $R_{10}$-$R_{11}$-$R_{12}$-$R_{13}$-$R_{14}$ $R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$ of Formula III$_{ZZZ}$, wherein ZZZ indicates any of the twenty amino acids;

(b'-1) a linker comprising residue $R_{29}$ of a consensus sequence provided in the "Consensus Sequence" section, e.g., a Linker 3 region;

(c) an anticodon that binds a respective codon in an mRNA, e.g., an anticodon hairpin domain (ACHD), wherein an ACHD comprises sufficient sequence, e.g., an anticodon triplet, to mediate, e.g., when present in an otherwise wildtype tRNA, pairing (with or without wobble) with a codon; In an embodiment the ACHD has at least 75, 80, 85, 85, 90, 95, or 100% identity with a naturally occurring ACHD, e.g., an ACHD encoded by a nucleic acid in Table 1. In an embodiment, the TREM can comprise a fragment or analog of an ACHD, e.g., an ACHD encoded by a nucleic acid in Table 1, which fragment in embodiments has ACHD activity and in other embodiments does not have ACHD activity.

In an embodiment the ACHD falls under the corresponding sequence of a consensus sequence provided in the "Consensus Sequence" section, or differs from the consensus sequence by no more than 1, 2, 5, or 10 positions;

In an embodiment, the ACHD comprises residues -$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$ of Formula I zzz, wherein ZZZ indicates any of the twenty amino acids;

In an embodiment, the ACHD comprises residues -$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$ of Formula II zzz, wherein ZZZ indicates any of the twenty amino acids;

In an embodiment, the ACHD comprises residues -$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$ of Formula III zzz, wherein ZZZ indicates any of the twenty amino acids;

(d) a variable loop domain (VLD), wherein a VLD comprises sufficient RNA sequence to mediate, e.g., when present in an otherwise wildtype tRNA, recognition of aminoacyl-tRNA synthetase, e.g., acts as a recognition site for aminoacyl-tRNA synthetase for amino acid charging of the TREM. In embodiments, a VLD mediates the stabilization of the TREM's tertiary structure. In an embodiment, a VLD modulates, e.g., increases, the specificity of the TREM, e.g., for its cognate amino acid, e.g., the VLD modulates the TREM's cognate adaptor function. In an embodiment the VLD has at least 75, 80, 85, 85, 90, 95, or 100% identity with a naturally occurring VLD, e.g., a VLD encoded by a nucleic acid in Table 1. In an embodiment, the TREM can comprise a fragment or analog of a VLD, e.g., a VLD encoded by a nucleic acid in Table 1, which fragment in embodiments has VLD activity and in other embodiments does not have VLD activity.

In an embodiment the VLD falls under the corresponding sequence of a consensus sequence provided in the "Consensus Sequence" section.

In an embodiment, the VLD comprises residue -$[R_{47}]_x$ of a consensus sequence provided in the "Consensus Sequence" section, wherein x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271);

(e) a thymine hairpin domain (THD), wherein a THD comprises sufficient RNA sequence, to mediate, e.g., when present in an otherwise wildtype tRNA, recognition of the ribosome, e.g., acts as a recognition site for the ribosome to form a TREM-ribosome complex during translation. In an embodiment the THD has at least 75, 80, 85, 85, 90, 95, or 100% identity with a naturally occurring THD, e.g., a THD encoded by a nucleic acid in Table 1. In an embodiment, the TREM can comprise a fragment or analog of a THD, e.g., a THD encoded by a nucleic acid in Table 1, which fragment in embodiments has THD activity and in other embodiments does not have THD activity.

In an embodiment the THD falls under the corresponding sequence of a consensus sequence provided in the "Consensus Sequence" section, or differs from the consensus sequence by no more than 1, 2, 5, or 10 positions;

In an embodiment, the THD comprises residues -$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$ of Formula I zzz, wherein ZZZ indicates any of the twenty amino acids;

In an embodiment, the THD comprises residues -$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$ of Formula II zzz, wherein ZZZ indicates any of the twenty amino acids;

In an embodiment, the THD comprises residues -$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$ of Formula III zzz, wherein ZZZ indicates any of the twenty amino acids;

(e'1) a linker comprising residue $R_{72}$ of a consensus sequence provided in the "Consensus Sequence" section, e.g., a Linker 4 region;

(f) under physiological conditions, it comprises a stem structure and one or a plurality of loop structures, e.g., 1, 2, or 3 loops. A loop can comprise a domain described herein, e.g., a domain selected from (a)-(e). A loop can comprise one or a plurality of domains. In an embodiment, a stem or loop structure has at least 75, 80, 85, 85, 90, 95, or 100% identity with a naturally occurring stem or loop structure, e.g., a stem or loop structure encoded by a nucleic acid in Table 1. In an embodiment, the TREM can comprise a fragment or analog of a stem or loop structure, e.g., a stem or loop structure encoded by a nucleic acid in Table 1, which fragment in embodiments has activity of a stem or loop structure, and in other embodiments does not have activity of a stem or loop structure;

(g) a tertiary structure, e.g., an L-shaped tertiary structure;

(h) adaptor function, i.e., the TREM mediates acceptance of an amino acid, e.g., its cognate amino acid and transfer of the AA in the initiation or elongation of a polypeptide chain; (i) cognate adaptor function wherein the TREM mediates acceptance and incorporation of an amino acid (e.g., cognate amino acid) associated in nature with the anti-codon of the TREM to initiate or elongate a polypeptide chain;

(j) non-cognate adaptor function, wherein the TREM mediates acceptance and incorporation of an amino acid (e.g., non-cognate amino acid) other than the amino acid associated in nature with the anti-codon of the TREM in the initiation or elongation of a polypeptide chain;

(k) a regulatory function, e.g., an epigenetic function (e.g., gene silencing function or signaling pathway modulation function), cell fate modulation function, mRNA stability modulation function, protein stability modulation function, protein transduction modulation function, or protein compartmentalization function;

(l) a structure which allows for ribosome binding;

(m) a post-transcriptional modification, e.g., a naturally occurring post-transcriptional modification;

(n) the ability to inhibit a functional property of a tRNA, e.g., any of properties (h)-(k) possessed by a tRNA;

(o) the ability to modulate cell fate;

(p) the ability to modulate ribosome occupancy;

(q) the ability to modulate protein translation;

(r) the ability to modulate mRNA stability;

(s) the ability to modulate protein folding and structure;

(t) the ability to modulate protein transduction or compartmentalization;

(u) the ability to modulate protein stability; or (v) the ability to modulate a signaling pathway, e.g., a cellular signaling pathway.

In an embodiment, a TREM comprises a full-length tRNA molecule or a fragment thereof.

In an embodiment, a TREM comprises the following properties: (a)-(e).

In an embodiment, a TREM comprises the following properties: (a) and (c).

In an embodiment, a TREM comprises the following properties: (a), (c) and (h).

In an embodiment, a TREM comprises the following properties: (a), (c), (h) and (b).

In an embodiment, a TREM comprises the following properties: (a), (c), (h) and (e).

In an embodiment, a TREM comprises the following properties: (a), (c), (h), (b) and (e).

In an embodiment, a TREM comprises the following properties: (a), (c), (h), (b), (e) and (g).

In an embodiment, a TREM comprises the following properties: (a), (c), (h) and (m).

In an embodiment, a TREM comprises the following properties: (a), (c), (h), (m), and (g).

In an embodiment, a TREM comprises the following properties: (a), (c), (h), (m) and (b).

In an embodiment, a TREM comprises the following properties: (a), (c), (h), (m) and (e).

In an embodiment, a TREM comprises the following properties: (a), (c), (h), (m), (g), (b) and (e).

In an embodiment, a TREM comprises the following properties: (a), (c), (h), (m), (g), (b), (e) and (q).

In an embodiment, a TREM comprises:

(i) an amino acid attachment domain that binds an amino acid (e.g., an AStD, as described in (a) herein; and (ii) an anticodon that binds a respective codon in an mRNA (e.g., an ACHD, as described in (c) herein).

In an embodiment the TREM comprises a flexible RNA linker which provides for covalent linkage of (i) to (ii).

In an embodiment, the TREM mediates protein translation.

In an embodiment a TREM comprises a linker, e.g., an RNA linker, e.g., a flexible RNA linker, which provides for covalent linkage between a first and a second structure or domain. In an embodiment, an RNA linker comprises at least 1, 2, 3, 4, 5, 6, 7, 8, 9, 10, 11, 12, 13, 14 or 15 ribonucleotides. A TREM can comprise one or a plurality of linkers, e.g., in embodiments a TREM comprising (a), (b), (c), (d) and (e) can have a first linker between a first and second domain, and a second linker between a third domain and another domain.

In an embodiment, the TREM comprises a sequence of Formula A: [L1]-[ASt Domain1]-[L2]-[DH Domain]-[L3]-[ACH Domain]-[VL Domain]-[TH Domain]-[L4]-[ASt Domain2].

In an embodiment, a TREM comprises an RNA sequence at least 60, 65, 70, 75, 80, 85, 90, 95, 96, 97, 98 or 99% identical with, or which differs by no more than 1, 2, 3, 4, 5, 10, 15, 20, 25, or 30 ribonucleotides from, an RNA sequence encoded by a DNA sequence listed in Table 1, or a fragment or functional fragment thereof. In an embodiment, a TREM comprises an RNA sequence encoded by a DNA sequence listed in Table 1, or a fragment or functional fragment thereof. In an embodiment, a TREM comprises an RNA sequence encoded by a DNA sequence at least 60, 65, 70, 75, 80, 85, 90, 95, 96, 97, 98 or 99% identical with a DNA sequence listed in Table 1, or a fragment or functional fragment thereof. In an embodiment, a TREM comprises a TREM domain, e.g., a domain described herein, comprising at least 60, 65, 70, 75, 80, 85, 90, 95, 96, 97, 98, or 99% identical with, or which differs by no more than 1, 2, 3, 4, 5, 10, or 15, ribonucleotides from, an RNA encoded by a DNA sequence listed in Table 1, or a fragment or a functional fragment thereof. In an embodiment, a TREM comprises a TREM domain, e.g., a domain described herein, comprising an RNA sequence encoded by DNA sequence listed in Table 1, or a fragment or functional fragment thereof. In an embodiment, a TREM comprises a TREM domain, e.g., a domain described herein, comprising an RNA sequence encoded by DNA sequence at least 60, 65, 70, 75, 80, 85, 90, 95, 96, 97, 98 or 99% identical with a DNA sequence listed in Table 1, or a fragment or functional fragment thereof.

In an embodiment, a TREM is 76-90 nucleotides in length. In embodiments, a TREM or a fragment or functional fragment thereof is between 10-90 nucleotides, between 10-80 nucleotides, between 10-70 nucleotides, between 10-60 nucleotides, between 10-50 nucleotides, between 10-40 nucleotides, between 10-30 nucleotides, between 10-20 nucleotides, between 20-90 nucleotides, between 20-80 nucleotides, 20-70 nucleotides, between 20-60 nucleotides, between 20-50 nucleotides, between 20-40 nucleotides, between 30-90 nucleotides, between 30-80 nucleotides, between 30-70 nucleotides, between 30-60 nucleotides, or between 30-50 nucleotides.

In an embodiment, a TREM is aminoacylated, e.g., charged, with an amino acid by an aminoacyl tRNA synthetase.

In an embodiment, a TREM is not charged with an amino acid, e.g., an uncharged TREM (uTREM).

In an embodiment, a TREM comprises less than a full length tRNA. In embodiments, a TREM can correspond to a naturally occurring fragment of a tRNA, or to a non-naturally occurring fragment. Exemplary fragments include: TREM halves (e.g., from a cleavage in the ACHD, e.g., in the anticodon sequence, e.g., 5'halves or 3' halves); a 5' fragment (e.g., a fragment comprising the 5' end, e.g., from a cleavage in a DHD or the ACHD); a 3' fragment (e.g., a fragment comprising the 3' end, e.g., from a cleavage in the THD); or an internal fragment (e.g., from a cleavage in one or more of the ACHD, DHD or THD).

A "TREM core fragment," as that term is used herein, refers to a portion of the sequence of Formula B: [L1]$_y$-[ASt Domain1]$_x$-[L2]$_y$-[DH Domain]$_y$-[L3]$_y$-[ACH Domain]$_x$-[VL Domain]$_y$-[TH Domain]$_y$-[L4]$_y$-[ASt Domain2]$_x$, wherein: x=1 and y=0 or 1.

A "TREM fragment," as used herein, refers to a portion of a TREM, wherein the TREM comprises a sequence of Formula A: [L1]-[ASt Domain1]-[L2]-[DH Domain]-[L3]-[ACH Domain]-[VL Domain]-[TH Domain]-[L4]-[ASt Domain2].

A "cognate adaptor function TREM," as that term is used herein, refers to a TREM which mediates initiation or elongation with the AA (the cognate AA) associated in nature with the anti-codon of the TREM.

"Decreased expression," as that term is used herein, refers to a decrease in comparison to a reference, e.g., in the case where altered control region, or addition of an agent, results in a decreased expression of the subject product, it is decreased relative to an otherwise similar cell without the alteration or addition.

An "exogenous nucleic acid," as that term is used herein, refers to a nucleic acid sequence that is not present in or differs by at least one nucleotide from the closest sequence in a reference cell, e.g., a cell into which the exogenous nucleic acid is introduced. In an embodiment, an exogenous nucleic acid comprises a nucleic acid that encodes a TREM.

An "exogenous TREM," as that term is used herein, refers to a TREM that:

(a) differs by at least one nucleotide or one post transcriptional modification from the closest sequence tRNA in a reference cell, e.g., a cell into which the exogenous nucleic acid is introduced;

(b) has been introduced into a cell other than the cell in which it was transcribed;

(c) is present in a cell other than one in which it naturally occurs; or (d) has an expression profile, e.g., level or distribution, that is non-wildtype, e.g., it is expressed at a higher level than wildtype. In an embodiment, the expression profile can be mediated by a change introduced into a nucleic acid that modulates expression or by addition of an agent that modulates expression of the RNA molecule. In an embodiment an exogenous TREM comprises 1, 2, 3 or 4 of properties (a)-(d).

A "GMP-grade composition," as that term is used herein, refers to a composition in compliance with current good manufacturing practice (cGMP) guidelines, or other similar requirements. In an embodiment, a GMP-grade composition can be used as a pharmaceutical product.

As used herein, the terms "increasing" and "decreasing" refer to modulating that results in, respectively, greater or lesser amounts of function, expression, or activity of a particular metric relative to a reference. For example, subsequent to administration to a cell, tissue or subject of a TREM described herein, the amount of a marker of a metric (e.g., protein translation, mRNA stability, protein folding) as described herein may be increased or decreased by at least 5%, 10%, 15%, 20%, 25%, 30%, 35%, 40%, 45%, 50%, 55%, 60%, 65%, 70%, 75%, 80%, 85%, 90%, 95% or 98%, 2×, 3×, 5×, 10× or more relative to the amount of the marker prior to administration or relative to the effect of a negative control agent. The metric may be measured subsequent to administration at a time that the administration has had the recited effect, e.g., at least 12 hours, 24 hours, one week, one month, 3 months, or 6 months, after a treatment has begun.

"Increased expression," as that term is used herein, refers to an increase in comparison to a reference, e.g., in the case where altered control region, or addition of an agent, results in an increased expression of the subject product, it is increased relative to an otherwise similar cell without the alteration or addition.

A "non-cognate adaptor function TREM," as that term is used herein, refers to a TREM which mediates initiation or elongation with an AA (a non-cognate AA) other than the AA associated in nature with the anti-codon of the TREM. In an embodiment, a non-cognate adaptor function TREM is also referred to as a mischarged TREM (mTREM).

A "non-naturally occurring sequence," as that term is used herein, refers to a sequence wherein an Adenine is replaced by a residue other than an analog of Adenine, a Cytosine is replaced by a residue other than an analog of Cytosine, a Guanine is replaced by a residue other than an analog of Guanine, and a Uracil is replaced by a residue other than an analog of Uracil. An analog refers to any possible derivative of the ribonucleotides, A, G, C or U. In an embodiment, a sequence having a derivative of any one of ribonucleotides A, G, C or U is a non-naturally occurring sequence.

A "pharmaceutical TREM composition," as that term is used herein, refers to a TREM composition that is suitable for pharmaceutical use. Typically, a pharmaceutical TREM composition comprises a pharmaceutical excipient. In an embodiment the TREM will be the only active ingredient in the pharmaceutical TREM composition. In embodiments the pharmaceutical TREM composition is free, substantially free, or has less than a pharmaceutically acceptable amount, of host cell proteins, DNA, e.g., host cell DNA, endotoxins, and bacteria.

A "post-transcriptional processing," as that term is used herein, with respect to a subject molecule, e.g., a TREM, RNA or tRNAs, refers to a covalent modification of the subject molecule. In an embodiment, the covalent modification occurs post-transcriptionally. In an embodiment, the covalent modification occurs co-transcriptionally. In an embodiment the modification is made in vivo, e.g., in a cell used to produce a TREM. In an embodiment the modification is made ex vivo, e.g., it is made on a TREM isolated or obtained from the cell which produced the TREM. In an embodiment, the post-transcriptional modification is selected from a post-transcriptional modification listed in Table 2.

A "synthetic TREM," as that term is used herein, refers to a TREM which was synthesized other than in or by a cell having an endogenous nucleic acid encoding the TREM, e.g., a synthetic TREM is synthetized by cell-free solid phase synthesis. A synthetic TREM can have the same, or a different, sequence, or tertiary structure, as a native tRNA.

A "recombinant TREM," as that term is used herein, refers to a TREM that was expressed in a cell modified by human intervention, having a modification that mediates the production of the TREM, e.g., the cell comprises an exogenous sequence encoding the TREM, or a modification that mediates expression, e.g., transcriptional expression or post-transcriptional modification, of the TREM. A recombinant TREM can have the same, or a different, sequence, set of post-transcriptional modifications, or tertiary structure, as a reference tRNA, e.g., a native tRNA.

A "tRNA", as that term is used herein, refers to a naturally occurring transfer ribonucleic acid in its native state.

A "TREM composition," as that term is used herein, refers to a composition comprising a plurality of TREMs, a plurality of TREM core fragments and/or a plurality of TREM fragments. A TREM composition can comprise one or more species of TREMs, TREM core fragments or TREM fragments. In an embodiment, the composition comprises only a single species of TREM, TREM core fragment or TREM fragment. In an embodiment, the TREM composition comprises a first TREM, TREM core fragment or TREM fragment species; and a second TREM, TREM core fragment or TREM fragment species. In an embodiment, the TREM composition comprises X TREM, TREM core fragment or TREM fragment species, wherein x=2, 3, 4, 5, 6, 7, 8, 9, or 10. In an embodiment, the TREM, TREM core fragment or TREM fragment has at least 70, 75, 80, 85, 90, or 95, or has 100%, identity with a sequence encoded by a nucleic acid in Table 1. A TREM composition can comprise one or more species of TREMs, TREM core fragments or TREM fragments. In an embodiment, the TREM composition is at least 10, 20, 30, 40, 50, 60, 70, 80, 90, 95 or 99% dry weight TREMs (for a liquid composition dry weight refers to the weight after removal of substantially all liquid, e.g., after lyophilization). In an embodiment, the composition is a liquid. In an embodiment, the composition is dry, e.g., a lyophilized material. In an embodiment, the composition is a frozen composition. In an embodiment, the composition is sterile. In an embodiment, the composition comprises at least 0.5 g, 1.0 g, 5.0 g, 10 g, 15 g, 25 g, 50 g, 100 g, 200 g, 400 g, or 500 g (e.g., as determined by dry weight) of TREM.

In an embodiment, at least X % of the TREMs in a TREM composition has a non-naturally occurring modification at a selected position, and X is 80, 90, 95, 96, 97, 98, 99, or 99.5.

In an embodiment, at least X % of the TREMs in a TREM composition has a non-naturally occurring modification at a first position and a non-naturally occurring modification at a second position, and X, independently, is 80, 90, 95, 96, 97, 98, 99, or 99.5. In embodiments, the modification at the first and second position is the same. In embodiments, the modification at the first and second position are different. In embodiments, the nucleotide at the first and second position is the same, e.g., both are adenine. In embodiments, the nucleotide at the first and second position are different, e.g., one is adenine and one is thymine.

In an embodiment, at least X % of the TREMs in a TREM composition has a non-naturally occurring modification at a first position and less than Y % have a non-naturally occurring modification at a second position, wherein X is 80, 90, 95, 96, 97, 98, 99, or 99.5 and Y is 20, 20, 5, 2, 1, 0.1, or 0.01. In embodiments, the nucleotide at the first and second position is the same, e.g., both are adenine. In embodiments the nucleotide at the first and second position are different, e.g., one is adenine and one is thymine.

TREM, TREM Core Fragment and TREM Fragment

A "tRNA-based effector molecule" or "TREM" refers to an RNA molecule comprising one or more of the properties described herein. A TREM can comprise a non-naturally occurring modification, e.g., as provided in Tables 4, 5, 6 or 7.

In an embodiment, a TREM includes a TREM comprising a sequence of Formula A; a TREM core fragment comprising a sequence of Formula B; or a TREM fragment comprising a portion of a TREM which TREM comprises a sequence of Formula A.

In an embodiment, a TREM comprises a sequence of Formula A: [L1]-[ASt Domain1]-[L2]-[DH Domain]-[L3]-[ACH Domain]-[VL Domain]-[TH Domain]-[L4]-[ASt Domain2]. In an embodiment, [VL Domain] is optional. In an embodiment, [L1] is optional.

In an embodiment, a TREM core fragment comprises a sequence of Formula B: $[L1]_y$-$[ASt Domain1]_x$-$[L2]_y$-$[DH Domain]_y$-$[L3]_y$-$[ACH Domain]_x$-$[VL Domain]_y$-$[TH Domain]_y$-$[L4]_y$-$[ASt Domain2]_x$, wherein: x=1 and γ-0 or 1. In an embodiment, y=0. In an embodiment, y=1.;

In an embodiment, a TREM fragment comprises a portion of a TREM, wherein the TREM comprises a sequence of Formula A: [L1]-[ASt Domain1]-[L2]-[DH Domain]-[L3]-[ACH Domain]-[VL Domain]-[TH Domain]-[L4]-[ASt Domain2], and wherein the TREM fragment comprises: one, two, three or all or any combination of the following: a TREM half (e.g., from a cleavage in the ACH Domain, e.g., in the anticodon sequence, e.g., a 5'half or a 3' half); a 5' fragment (e.g., a fragment comprising the 5' end, e.g., from a cleavage in a DH Domain or the ACH Domain); a 3' fragment (e.g., a fragment comprising the 3' end, e.g., from a cleavage in the TH Domain); or an internal fragment (e.g., from a cleavage in any one of the ACH Domain, DH Domain or TH Domain). Exemplary TREM fragments include TREM halves (e.g., from a cleavage in the ACHD, e.g., 5'TREM halves or 3' TREM halves), a 5' fragment (e.g., a fragment comprising the 5' end, e.g., from a cleavage in a DHD or the ACHD), a 3' fragment (e.g., a fragment comprising the 3' end of a TREM, e.g., from a cleavage in the THD), or an internal fragment (e.g., from a cleavage in one or more of the ACHD, DHD or THD).

In an embodiment, a TREM, a TREM core fragment or a TREM fragment can be charged with an amino acid (e.g., a cognate amino acid); charged with a non-cognate amino acid (e.g., a mischarged TREM (mTREM)); or not charged with an amino acid (e.g., an uncharged TREM (uTREM)). In an embodiment, a TREM, a TREM core fragment or a TREM fragment can be charged with an amino acid selected from alanine, arginine, asparagine, aspartate, cysteine, glutamine, glutamate, glycine, histidine, isoleucine, methionine, leucine, lysine, phenylalanine, proline, serine, threonine, tryptophan, tyrosine, or valine.

In some embodiments, a non-extended anticodon is an anticodon of no more than three nucleotides. In an embodiment, a non-extended codon pairs with no more than three codon nucleotides on a nucleic acid being translated.

In an embodiment, the TREM, TREM core fragment or TREM fragment is a cognate TREM. In an embodiment, the TREM, TREM core fragment or TREM fragment is a non-cognate TREM. In an embodiment, the TREM, TREM core fragment or TREM fragment recognizes a codon provided in Table 2 or Table 3.

TABLE 2

| List of codons |
| --- |
| AAA |
| AAC |
| AAG |
| AAU |
| ACA |
| ACC |
| ACG |
| ACU |
| AGA |
| AGC |
| AGG |
| AGU |
| AUA |
| AUC |
| AUG |
| AUU |
| CAA |
| CAC |
| CAG |
| CAU |
| CCA |
| CCC |
| CCG |
| CCU |
| CGA |
| CGC |
| CGG |
| CGU |
| CUA |
| CUC |
| CUG |
| CUU |
| GAA |
| GAC |
| GAG |
| GAU |
| GCA |
| GCC |
| GCG |
| GCU |
| GGA |
| GGC |

TABLE 2-continued

List of codons

GGG
GGU
GUA
GUC
GUG
GUU
UAA
UAC
UAG
UAU
UCA
UCC
UCG
UCU
UGA
UGC
UGG
UGU
UUA
UUC
UUG
UUU

TABLE 3

Amino acids and corresponding codons

| Amino Acid | mRNA codons |
|---|---|
| Alanine | GCU, GCC, GCA, GCG |
| Arginine | CGU, CGC, CGA, CGG, AGA, AGG |
| Asparagine | AAU, AAC |
| Aspartate | GAU, GAC |
| Cysteine | UGU, UGC |
| Glutamate | GAA, GAG |
| Glutamine | CAA, CAG |
| Glycine | GGU, GGC, GGA, GGG |
| Histidine | CAU, CAC |
| Isoleucine | AUU, AUC, AUA |
| Leucine | UUA, UUG, CUU, CUC, CUA, CUG |
| Lysine | AAA, AAG |
| Methionine | AUG |
| Phenylalanine | UUU, UUC |
| Proline | CCU, CCC, CCA, CCG |
| Serine | UCU, UCC, UCA, UCG, AGU, AGC |
| Stop | UAA, UAG, UGA |
| Threonine | ACU, ACC, ACA, ACG |
| Tryptophan | UGG |
| Tyrosine | UAU, UAC |
| Valine | GUU, GUC, GUA, GUG |

In an embodiment, a TREM comprises a ribonucleic acid (RNA) sequence encoded by a deoxyribonucleic acid (DNA) sequence disclosed in Table 1, e.g., any one of SEQ ID NOs: 1-451 disclosed in Table 1. In an embodiment, a TREM comprises an RNA sequence at least 60%, 65%, 70%, 75%, 80%, 82%, 85%, 87%, 88%, 90%, 92%, 95%, 96%, 97%, 98%, or 99% identical to an RNA sequence encoded by a DNA sequence provided in Table 1, e.g., any one of SEQ ID NOs: 1-451 disclosed in Table 1. In an embodiment, a TREM comprises an RNA sequence encoded by a DNA sequence at least 60%, 65%, 70%, 75%, 80%, 82%, 85%, 87%, 88%, 90%, 92%, 95%, 96%, 97%, 98%, or 99% identical to a DNA sequence provided in Table 1, e.g., any one of SEQ ID NOs: 1-451 disclosed in Table 1.

In an embodiment, a TREM, a TREM core fragment, or TREM fragment comprises at least 5, 10, 15, 20, 25, or 30 consecutive nucleotides of an RNA sequence encoded by a DNA sequence disclosed in Table 1, e.g., at least 5, 10, 15, 20, 25, or 30 consecutive nucleotides of an RNA sequence encoded by any one of SEQ ID NOs: 1-451 disclosed in Table 1. In an embodiment, a TREM, a TREM core fragment, or TREM fragment comprises at least 5, 10, 15, 20, 25, or 30 consecutive nucleotides of an RNA sequence at least 60%, 65%, 70%, 75%, 80%, 82%, 85%, 87%, 88%, 90%, 92%, 95%, 96%, 97%, 98%, or 99% identical to an RNA sequence encoded by a DNA sequence provided in Table 1, e.g., any one of SEQ ID NOs: 1-451 disclosed in Table 1. In an embodiment, a TREM, a TREM core fragment, or TREM fragment comprises at least 5, 10, 15, 20, 25, or 30 consecutive nucleotides of an RNA sequence encoded by a DNA sequence at least 60%, 65%, 70%, 75%, 80%, 82%, 85%, 87%, 88%, 90%, 92%, 95%, 96%, 97%, 98%, or 99% identical to a DNA sequence provided in Table 1, e.g., any one of SEQ ID NOs: 1-451 disclosed in Table 1.

In an embodiment, a TREM core fragment or a TREM fragment comprises at least 5%, 10%, 15%, 20%, 25%, 30%, 35%, 40%, 50%, 55%, 60%, 65%, 70%, 75%, 80%, 85%, 90%, 95%, 96%, 97%, 98% or 99% of an RNA sequence encoded by a DNA sequence provided in Table 1, e.g., any one of SEQ ID NOs: 1-451 disclosed in Table 1. In an embodiment, a TREM core fragment or a TREM fragment comprises at least 5%, 10%, 15%, 20%, 25%, 30%, 35%, 40%, 50%, 55%, 60%, 65%, 70%, 75%, 80%, 85%, 90%, 95%, 96%, 97%, 98% or 99% of an RNA sequence at least 80%, 85%, 90%, 95%, 96%, 97%, 98%, or 99% identical to an RNA sequence encoded by a DNA sequence provided in Table 1, e.g., any one of SEQ ID NOs: 1-451 disclosed in Table 1. In an embodiment, a TREM core fragment or a TREM fragment comprises at least 5%, 10%, 15%, 20%, 25%, 30%, 35%, 40%, 50%, 55%, 60%, 65%, 70%, 75%, 80%, 85%, 90%, 95%, 96%, 97%, 98% or 99% of an RNA sequence encoded by a DNA sequence at least 80%, 85%, 90%, 95%, 96%, 97%, 98%, or 99% identical to a DNA sequence provided in Table 1, e.g., any one of SEQ ID NOs: 1-451 disclosed in Table 1.

In an embodiment, a TREM core fragment or a TREM fragment comprises at least 5 ribonucleotides (nt), 10 nt, 15 nt, 20 nt, 25 nt, 30 nt, 35 nt, 40 nt, 45 nt, 50 nt, 55 nt or 60 nt (but less than the full length) of an RNA sequence encoded by a DNA sequence disclosed in Table 1, e.g., any one of SEQ ID NOs: 1-451 disclosed in Table 1. In an embodiment, a TREM core fragment or a TREM fragment comprises at least 5 ribonucleotides (nt), 10 nt, 15 nt, 20 nt, 25 nt, 30 nt, 35 nt, 40 nt, 45 nt, 50 nt, 55 nt or 60 nt (but less than the full length) of an RNA sequence which is at least 80%, 85%, 90%, 95%, 96%, 97%, 98%, 99% or 100% identical to an RNA sequence encoded by a DNA sequence provided in Table 1, e.g., any one of SEQ ID NOs: 1-451 disclosed in Table 1. In an embodiment, a TREM core fragment or a TREM fragment comprises at least 5 ribonucleotides (nt), 10 nt, 15 nt, 20 nt, 25 nt, 30 nt, 35 nt, 40 nt, 45 nt, 50 nt, 55 nt or 60 nt (but less than the full length) of an RNA sequence encoded by a DNA sequence with at least 80%, 82%, 85%, 87%, 88%, 90%, 92%, 95%, 96%, 97%, 98%, 99% or 100% identity to a DNA sequence provided in Table 1, e.g., any one of SEQ ID NOs: 1-451 disclosed in Table 1.

In an embodiment, a TREM core fragment or a TREM fragment comprises a sequence of a length of between 10-90 ribonucleotides (rnt), between 10-80 rnt, between 10-70 rnt, between 10-60 rnt, between 10-50 rnt, between 10-40 rnt, between 10-30 rnt, between 10-20 rnt, between 20-90 rnt, between 20-80 rnt, 20-70 rnt, between 20-60 rnt, between 20-50 rnt, between 20-40 rnt, between 30-90 rnt, between 30-80 rnt, between 30-70 rnt, between 30-60 rnt, or between 30-50 rnt

TABLE 1

| List of tRNA Sequences | | |
| --- | --- | --- |
| SEQ ID NO | tRNA name | tRNA sequence |
| 1 | Ala_AGC_chr6:28763<br>741-28763812 (-) | GGGGGTATAGCTCAGTGGTAGAGCGCGTGCT<br>TAGCATGCACGAGGTCCTGGGTTCGATCCCC |
| 2 | Ala_AGC_chr6:26687<br>485-26687557 (+) | GGGGAATTAGCTCAAGTGGTAGAGCGCTTGC<br>TTAGCACGCAAGAGGTAGTGGGATCGATGCC |
| 3 | Ala_AGC_chr6:26572<br>092-26572164 (-) | GGGGAATTAGCTCAAATGGTAGAGCGCTCGC<br>TTAGCATGCGAGAGGTAGCGGGATCGATGCC |
| 4 | Ala_AGC_chr6:26682<br>715-26682787 (+) | GGGGAATTAGCTCAAGTGGTAGAGCGCTTGC<br>TTAGCATGCAAGAGGTAGTGGGATCGATGCC |
| 5 | Ala_AGC_chr6:26705<br>606-26705678 (+) | GGGGAATTAGCTCAAGCGGTAGAGCGCTTGC<br>TTAGCATGCAAGAGGTAGTGGGATCGATGCC |
| 6 | Ala_AGC_chr6:26673<br>590-26673662 (+) | GGGGAATTAGCTCAAGTGGTAGAGCGCTTGC<br>TTAGCATGCAAGAGGTAGTGGGATCAATGCC |
| 7 | Ala_AGC_chr14:8944<br>5442-89445514 (+) | GGGGAATTAGCTCAAGTGGTAGAGCGCTCGC<br>TTAGCATGCGAGAGGTAGTGGGATCGATGCC |
| 8 | Ala_AGC_chr6:58196<br>623-58196695 (-) | GGGGAATTAGCCCAAGTGGTAGAGCGCTTGC<br>TTAGCATGCAAGAGGTAGTGGGATCGATGCC |
| 9 | Ala_AGC_chr6:28806<br>221-28806292 (-) | GGGGGTGTAGCTCAGTGGTAGAGCGCGTGCT<br>TAGCATGCACGAGGCCCCGGGTTCAATCCCC |
| 10 | Ala_AGC_chr6:28574<br>933-28575004 (+) | GGGGGTGTAGCTCAGTGGTAGAGCGCGTGCT<br>TAGCATGTACGAGGTCCCGGGTTCAATCCCC |
| 11 | Ala_AGC_chr6:28626<br>014-28626085 (-) | GGGGATGTAGCTCAGTGGTAGAGCGCATGCT<br>TAGCATGCATGAGGTCCCGGGTTCGATCCCC |
| 12 | Ala_AGC_chr6:28678<br>366-28678437 (+) | GGGGGTGTAGCTCAGTGGTAGAGCGCGTGCT<br>TAGCATGCACGAGGCCCTGGGTTCAATCCCC |
| 13 | Ala_AGC_chr6:28779<br>849-28779920 (-) | GGGGGTATAGCTCAGCGGTAGAGCGCGTGCT<br>TAGCATGCACGAGGTCCTGGGTTCAATCCCC |
| 14 | Ala_AGC_chr6:28687<br>481-28687552 (+) | GGGGGTGTAGCTCAGTGGTAGAGCGCGTGCT<br>TAGCATGCACGAGGCCCCGGGTTCAATCCCT |
| 15 | Ala_AGC_chr2:27274<br>082-27274154 (+) | GGGGGATTAGCTCAAATGGTAGAGCGCTCGC<br>TTAGCATGCGAGAGGTAGCGGGATCGATGCC |
| 16 | Ala_AGC_chr6:26730<br>737-26730809 (+) | GGGGAATTAGCTCAGGCGGTAGAGCGCTCGC<br>TTAGCATGCGAGAGGTAGCGGGATCGACGCC |
| 17 | Ala_CGC_chr6:26553<br>731-26553802 (+) | GGGGATGTAGCTCAGTGGTAGAGCGCATGCT<br>TCGCATGTATGAGGTCCCGGGTTCGATCCCC |
| 18 | Ala_CGC_chr6:28641<br>613-28641684 (-) | GGGGATGTAGCTCAGTGGTAGAGCGCATGCT<br>TCGCATGTATGAGGCCCCGGGTTCGATCCCC |
| 19 | Ala_CGC_chr2:15725<br>7281-157257352 (+) | GGGGATGTAGCTCAGTGGTAGAGCGCGCGCT<br>TCGCATGTGTGAGGTCCCGGGTTCAATCCCC |
| 20 | Ala_CGC_chr6:28697<br>092-28697163 (+) | GGGGGTGTAGCTCAGTGGTAGAGCGCGTGCT<br>TCGCATGTACGAGGCCCCGGGTTCGACCCCC |
| 21 | Ala_TGC_chr6:28757<br>547-28757618 (-) | GGGGGTGTAGCTCAGTGGTAGAGCGCATGCT<br>TTGCATGTATGAGGTCCCGGGTTCGATCCCC |
| 22 | Ala_TGC_chr6:28611<br>222-28611293 (+) | GGGGATGTAGCTCAGTGGTAGAGCGCATGCT<br>TTGCATGTATGAGGTCCCGGGTTCGATCCCC |
| 23 | Ala_TGC_chr5:18063<br>3868-180633939 (+) | GGGGATGTAGCTCAGTGGTAGAGCGCATGCT<br>TTGCATGTATGAGGCCCCGGGTTCGATCCCC |
| 24 | Ala_TGC_chr12:1254<br>24512-125424583 (+) | GGGGATGTAGCTCAGTGGTAGAGCGCATGCT<br>TTGCACGTATGAGGCCCCGGGTTCAATCCCC |
| 25 | Ala_TGC_chr6:28785<br>012-28785083 (-) | GGGGGTGTAGCTCAGTGGTAGAGCGCATGCT<br>TTGCATGTATGAGGCCTCGGGTTCGATCCCC |

TABLE 1-continued

| List of tRNA Sequences | | |
|---|---|---|
| SEQ ID NO | tRNA name | tRNA sequence |
| 26 | Ala_TGC_chr6:28726 141-28726212 (-) | GGGGGTGTAGCTCAGTGGTAGAGCACATGCT TTGCATGTGTGAGGCCCCGGGTTCGATCCCC |
| 27 | Ala_TGC_chr6:28770 577-28770647 (-) | GGGGGTGTAGCTCAGTGGTAGAGCGCATGCT TTGCATGTATGAGGCCTCGGTTCGATCCCCG |
| 28 | Arg_ACG_chr6:26328 368-26328440 (+) | GGGCCAGTGGCGCAATGGATAACGCGTCTGA CTACGGATCAGAAGATTCCAGGTTCGACTCC |
| 29 | Arg_ACG_chr3:45730 491-45730563 (-) | GGGCCAGTGGCGCAATGGATAACGCGTCTGA CTACGGATCAGAAGATTCTAGGTTCGACTCC |
| 30 | Arg_CCG_chr6:28710 729-28710801 (-) | GGCCGCGTGGCCTAATGGATAAGGCGTCTGA TTCCGGATCAGAAGATTGAGGGTTCGAGTCC |
| 31 | Arg_CCG_chr17:6601 6013-66016085 (-) | GACCCAGTGGCCTAATGGATAAGGCATCAGC CTCCGGAGCTGGGGATTGTGGGTTCGAGTCC |
| 32 | Arg_CCT_chr17:7303 0001-73030073 (+) | GCCCCAGTGGCCTAATGGATAAGGCACTGGC CTCCTAAGCCAGGGATTGTGGGTTCGAGTCC |
| 33 | Arg_CCT_chr17:7303 0526-73030598 (-) | GCCCCAGTGGCCTAATGGATAAGGCACTGGC CTCCTAAGCCAGGGATTGTGGGTTCGAGTCC |
| 34 | Arg_CCT_chr16:3202 901-3202973 (+) | GCCCCGGTGGCCTAATGGATAAGGCATTGGC CTCCTAAGCCAGGGATTGTGGGTTCGAGTCC |
| 35 | Arg_CCT_chr7:13902 5446-139025518 (+) | GCCCCAGTGGCCTAATGGATAAGGCATTGGC CTCCTAAGCCAGGGATTGTGGGTTCGAGTCC |
| 36 | Arg_CCT_chr16:3243 918-3243990 (+) | GCCCCAGTGGCCTGATGGATAAGGTACTGGC CTCCTAAGCCAGGGATTGTGGGTTCGAGTTC |
| 37 | Arg_TCG_chr15:8987 8304-89878376 (+) | GGCCGCGTGGCCTAATGGATAAGGCGTCTGA CTTCGGATCAGAAGATTGCAGGTTCGAGTCC |
| 38 | Arg_TCG_chr6:26323 046-26323118 (+) | GACCACGTGGCCTAATGGATAAGGCGTCTGA CTTCGGATCAGAAGATTGAGGGTTCGAATCC |
| 39 | Arg_TCG_chr17:7303 1208-73031280 (+) | GACCGCGTGGCCTAATGGATAAGGCGTCTGA CTTCGGATCAGAAGATTGAGGGTTCGAGTCC |
| 40 | Arg_TCG_chr6:26299 905-26299977 (+) | GACCACGTGGCCTAATGGATAAGGCGTCTGA CTTCGGATCAGAAGATTGAGGGTTCGAATCC |
| 41 | Arg_TCG_chr6:28510 891-28510963 (-) | GACCACGTGGCCTAATGGATAAGGCGTCTGA CTTCGGATCAGAAGATTGAGGGTTCGAATCC |
| 42 | Arg_TCG_chr9:11296 0803-112960875 (+) | GGCCGTGTGGCCTAATGGATAAGGCGTCTGA CTTCGGATCAAAAGATTGCAGGTTTGAGTTC |
| 43 | Arg_TCT_chr1:94313 129-94313213 (+) | GGCTCCGTGGCGCAATGGATAGCGCATTGGA CTTCTAGAGGCTGAAGGCATTCAAAGGTTCC |
| 44 | Arg_TCT_chr17:8024 243-8024330 (+) | GGCTCTGTGGCGCAATGGATAGCGCATTGGA CTTCTAGTGACGAATAGAGCAATTCAAAGGT |
| 45 | Arg_TCT_chr9:13110 2355-131102445 (-) | GGCTCTGTGGCGCAATGGATAGCGCATTGGA CTTCTAGCTGAGCCTAGTGTGGTCATTCAAA |
| 46 | Arg_TCT_chr11:5931 8767-59318852 (+) | GGCTCTGTGGCGCAATGGATAGCGCATTGGA CTTCTAGATAGTTAGAGAAATTCAAAGGTTG |
| 47 | Arg_TCT_chr1:15911 1401-159111474 (-) | GTCTCTGTGGCGCAATGGACGAGCGCGCTGG ACTTCTAATCCAGAGGTTCCGGGTTCGAGTC |
| 48 | Arg_TCT_chr6:27529 963-27530049 (+) | GGCTCTGTGGCGCAATGGATAGCGCATTGGA CTTCTAGCCTAAATCAAGAGATTCAAAGGTT |
| 49 | Asn_GTT_chr1:16151 0031-161510104 (+) | GTCTCTGTGGCGCAATCGGTTAGCGCGTTCG GCTGTTAACCGAAAGGTTGGTGGTTCGATCC |
| 50 | Asn_GTT_chr1:14387 9832-143879905 (-) | GTCTCTGTGGCGCAATCGGCTAGCGCGTTTG GCTGTTAACTAAAAGGTTGGCGGTTCGAACC |

TABLE 1-continued

| List of tRNA Sequences | | |
|---|---|---|
| SEQ ID NO | tRNA name | tRNA sequence |
| 51 | Asn_GTT_chr1:14430 1611-144301684 (+) | GTCTCTGTGGTGCAATCGGTTAGCGCGTTCCG CTGTTAACCGAAAGCTTGGTGGTTCGAGCCC |
| 52 | Asn_GTT_chr1:14932 6272-149326345 (-) | GTCTCTGTGGCGCAATCGGCTAGCGCGTTTG GCTGTTAACTAAAAAGTTGGTGGTTCGAACA |
| 53 | Asn_GTT_chr1:14824 8115-148248188 (+) | GTCTCTGTGGCGCAATCGGTTAGCGCGTTCG GCTGTTAACCGAAAGGTTGGTGGTTCGAGCC |
| 54 | Asn_GTT_chr1:14859 8314-148598387 (-) | GTCTCTGTGGCGCAATCGGTTAGCGCATTCG GCTGTTAACCGAAAGGTTGGTGGTTCGAGCC |
| 55 | Asn_GTT_chr1:17216 172-17216245 (+) | GTCTCTGTGGCGCAATCGGTTAGCGCGTTCG GCTGTTAACCGAAAGATTGGTGGTTCGAGCC |
| 56 | Asn_GTT_chr1:16847 080-16847153 (-) | GTCTCTGTGGCGCAATCGGTTAGCGCGTTCG GCTGTTAACTGAAAGGTTGGTGGTTCGAGCC |
| 57 | Asn_GTT_chr1:14923 0570-149230643 (-) | GTCTCTGTGGCGCAATGGGTTAGCGCGTTCG GCTGTTAACCGAAAGGTTGGTGGTTCGAGCC |
| 58 | Asn_GTT_chr1:14800 0805-148000878 (+) | GTCTCTGTGGCGTAGTCGGTTAGCGCGTTCG GCTGTTAACCGAAAAGTTGGTGGTTCGAGCC |
| 59 | Asn_GTT_chr1:14971 1798-149711871 (-) | GTCTCTGTGGCGCAATCGGCTAGCGCGTTTG GCTGTTAACTAAAAGGTTGGTGGTTCGAACC |
| 60 | Asn_GTT_chr1:14597 9034-145979107 (-) | GTCTCTGTGGCGCAATCGGTTAGCGCGTTCG GCTGTTAACTGAAAGGTTAGTGGTTCGAGCC |
| 61 | Asp_GTC_chr12:9889 7281-98897352 (+) | TCCTCGTTAGTATAGTGGTTAGTATCCCCGCC TGTCACGCGGGAGACCGGGGTTCAATTCCCC |
| 62 | Asp_GTC_chr1:16141 0615-161410686 (-) | TCCTCGTTAGTATAGTGGTGAGTATCCCCGCC TGTCACGCGGGAGACCGGGGTTCGATTCCCC |
| 63 | Asp_GTC_chr6:27551 236-27551307 (-) | TCCTCGTTAGTATAGTGGTGAGTGTCCCCGTC TGTCACGCGGGAGACCGGGGTTCGATTCCCC |
| 64 | Cys_GCA_chr7:14900 7281-149007352 (+) | GGGGGCATAGCTCAGTGGTAGAGCATTTGAC TGCAGATCAAGAGGTCCCTGGTTCAAATCCA |
| 65 | Cys_GCA_chr7:14907 4601-149074672 (-) | GGGGGTATAGCTCAGGGGTAGAGCATTTGAC TGCAGATCAAGAGGTCCCTGGTTCAAATCCA |
| 66 | Cys_GCA_chr7:14911 2229-149112300 (-) | GGGGGTATAGCTTAGCGGTAGAGCATTTGAC TGCAGATCAAGAGGTCCCCGGTTCAAATCCG |
| 67 | Cys_GCA_chr7:14934 4046-149344117 (-) | GGGGGTATAGCTTAGGGGTAGAGCATTTGAC TGCAGATCAAAAGGTCCCTGGTTCAAATCCA |
| 68 | Cys_GCA_chr7:14905 2766-149052837 (-) | GGGGGTATAGCTCAGGGGTAGAGCATTTGAC TGCAGATCAAGAGGTCCCCAGTTCAAATCTG |
| 69 | Cys_GCA_chr17:3701 7937-37018008 (-) | GGGGGTATAGCTCAGGGGTAGAGCATTTGAC TGCAGATCAAGAGTCCCCGGTTCAAATCCG |
| 70 | Cys_GCA_chr7:14928 1816-149281887 (+) | GGGGGTATAGCTCAGGGGTAGAGCATTTGAC TGCAGATCAAGAGGTCTCTGGTTCAAATCCA |
| 71 | Cys_GCA_chr7:14924 3631-149243702 (+) | GGGGGTATAGCTCAGGGGTAGAGCACTTGAC TGCAGATCAAGAAGTCCTTGGTTCAAATCCA |
| 72 | Cys_GCA_chr7:14938 8272-149388343 (-) | GGGGATATAGCTCAGGGGTAGAGCATTTGAC TGCAGATCAAGAGGTCCCCGGTTCAAATCCG |
| 73 | Cys_GCA_chr7:14907 2850-149072921 (-) | GGGGGTATAGTTCAGGGGTAGAGCATTTGAC TGCAGATCAAGAGGTCCCTGGTTCAAATCCA |
| 74 | Cys_GCA_chr7:14931 0156-149310227 (-) | GGGGGTATAGCTCAGGGGTAGAGCATTTGAC TGCAAATCAAGAGGTCCCTGATTCAAATCCA |

TABLE 1-continued

| List of tRNA Sequences | | |
|---|---|---|
| SEQ ID NO | tRNA name | tRNA sequence |
| 75 | Cys_GCA_chr4:12443 0005-124430076 (-) | GGGGGTATAGCTCAGTGGTAGAGCATTTGAC TGCAGATCAAGAGGTCCCCGGTTCAAATCCG |
| 76 | Cys_GCA_chr7:14929 5046-149295117 (+) | GGGCGTATAGCTCAGGGGTAGAGCATTTGAC TGCAGATCAAGAGGTCCCCAGTTCAAATCTG |
| 77 | Cys_GCA_chr7:14936 1915-149361986 (+) | GGGGGTATAGCTCACAGGTAGAGCATTTGAC TGCAGATCAAGAGGTCCCCGGTTCAAATCTG |
| 78 | Cys_GCA_chr7:14925 3802-149253871 (+) | GGGCGTATAGCTCAGGGGTAGAGCATTTGAC TGCAGATCAAGAGGTCCCCAGTTCAAATCTG |
| 79 | Cys_GCA_chr7:14929 2305-149292376 (-) | GGGGGTATAGCTCACAGGTAGAGCATTTGAC TGCAGATCAAGAGGTCCCCGGTTCAAATCCG |
| 80 | Cys_GCA_chr7:14928 6164-149286235 (-) | GGGGGTATAGCTCAGGGGTAGAGCACTTGAC TGCAGATCAAGAGGTCCCTGGTTCAAATCCA |
| 81 | Cys_GCA_chr17:3702 5545-37025616 (-) | GGGGGTATAGCTCAGTGGTAGAGCATTTGAC TGCAGATCAAGAGGTCCCTGGTTCAAATCCG |
| 82 | Cys_GCA_chr15:8003 6997-80037069 (+) | GGGGGTATAGCTCAGTGGGTAGAGCATTTGA CTGCAGATCAAGAGGTCCCCGGTTCAAATCC |
| 83 | Cys_GCA_chr3:13194 7944-131948015 (-) | GGGGGTGTAGCTCAGTGGTAGAGCATTTGAC TGCAGATCAAGAGGTCCCTGGTTCAAATCCA |
| 84 | Cys_GCA_chr1:93981 834-93981906 (-) | GGGGGTATAGCTCAGGTGGTAGAGCATTTGA CTGCAGATCAAGAGGTCCCCGGTTCAAATCC |
| 85 | Cys_GCA_chr14:7342 9679-73429750 (+) | GGGGGTATAGCTCAGGGGTAGAGCATTTGAC TGCAGATCAAGAGGTCCCCGGTTCAAATCCG |
| 86 | Cys_GCA_chr3:13195 0642-131950713 (-) | GGGGGTATAGCTCAGGGGTAGAGCATTTGAC TGCAGATCAAGAGGTCCCTGGTTCAAATCCA |
| 87 | Gln_CTG_chr6:18836 402-18836473 (+) | GGTTCCATGGTGTAATGGTTAGCACTCTGGA CTCTGAATCCAGCGATCCGAGTTCAAATCTC |
| 88 | Gln_CTG_chr6:27515 531-27515602 (-) | GGTTCCATGGTGTAATGGTTAGCACTCTGGA CTCTGAATCCAGCGATCCGAGTTCAAGTCTC |
| 89 | Gln_CTG_chr1:14596 3304-145963375 (+) | GGTTCCATGGTGTAATGGTGAGCACTCTGGA CTCTGAATCCAGCGATCCGAGTTCGAGTCTC |
| 90 | Gln_CTG_chr1:14773 7382-147737453 (-) | GGTTCCATGGTGTAATGGTAAGCACTCTGGA CTCTGAATCCAGCGATCCGAGTTCGAGTCTC |
| 91 | Gln_CTG_chr6:27263 212-27263283 (+) | GGTTCCATGGTGTAATGGTTAGCACTCTGGA CTCTGAATCCGGTAATCCGAGTTCAAATCTC |
| 92 | Gln_CTG_chr6:27759 135-27759206 (-) | GGCCCCATGGTGTAATGGTCAGCACTCTGGA CTCTGAATCCAGCGATCCGAGTTCAAATCTC |
| 93 | Gln_CTG_chr1:14780 0937-147801008 (+) | GGTTCCATGGTGTAATGGTAAGCACTCTGGA CTCTGAATCCAGCCATCTGAGTTCGAGTCTCT |
| 94 | Gln_TTG_chr17:4726 9890-47269961 (+) | GGTCCCATGGTGTAATGGTTAGCACTCTGGA CTTTGAATCCAGCGATCCGAGTTCAAATCTC |
| 95 | Gln_TTG_chr6:28557 156-28557227 (+) | GGTCCCATGGTGTAATGGTTAGCACTCTGGA CTTTGAATCCAGCAATCCGAGTTCGAATCTC |
| 96 | Gln_TTG_chr6:26311 424-26311495 (-) | GGCCCCATGGTGTAATGGTTAGCACTCTGGA CTTTGAATCCAGCGATCCGAGTTCAAATCTC |
| 97 | Gln_TTG_chr6:14550 3859-145503930 (+) | GGTCCCATGGTGTAATGGTTAGCACTCTGGG CTTTGAATCCAGCAATCCGAGTTCGAATCTTG |
| 98 | Glu_CTC_chr1:14539 9233-145399304 (-) | TCCCTGGTGGTCTAGTGGTTAGGATTCGGCG CTCTCACCGCCGCGGCCCGGGTTCGATTCCC |

TABLE 1-continued

List of tRNA Sequences

| SEQ ID NO | tRNA name | tRNA sequence |
|---|---|---|
| 99 | Glu_CTC_chr1:24916 8447-249168518 (+) | TCCCTGGTGGTCTAGTGGTTAGGATTCGGCG CTCTCACCGCCGCGGCCCGGGTTCGATTCCC |
| 100 | Glu_TTC_chr2:13109 4701-131094772 (-) | TCCCATATGGTCTAGCGGTTAGGATTCCTGGT TTTCACCCAGGTGGCCCGGGTTCGACTCCCG |
| 101 | Glu_TTC_chr13:4549 2062-45492133 (-) | TCCCACATGGTCTAGCGGTTAGGATTCCTGGT TTTCACCCAGGCGGCCCGGGTTCGACTCCCG |
| 102 | Glu_TTC_chr1:17199 078-17199149 (+) | TCCCTGGTGGTCTAGTGGCTAGGATTCGGCG CTTTCACCGCCGCGGCCCGGGTTCGATTCCCG |
| 103 | Glu_TTC_chr1:16861 774-16861845 (-) | TCCCTGGTGGTCTAGTGGCTAGGATTCGGCG CTTTCACCGCCGCGGCCCGGGTTCGATTCCCG |
| 104 | Gly_CCC_chr1:16872 434-16872504 (-) | GCATTGGTGGTTCAGTGGTAGAATTCTCGCCT CCCACGCGGGAGACCCGGGTTCAATTCCCGG |
| 105 | Gly_CCC_chr2:70476 123-70476193 (-) | GCGCCGCTGGTGTAGTGGTATCATGCAAGAT TCCCATTCTTGCGACCCGGGTTCGATTCCCGG |
| 106 | Gly_CCC_chr17:1976 4175-19764245 (+) | GCATTGGTGGTTCAATGGTAGAATTCTCGCCT CCCACGCAGGAGACCCAGGTTCGATTCCTGG |
| 107 | Gly_GCC_chr1:16141 3094-161413164 (+) | GCATGGGTGGTTCAGTGGTAGAATTCTCGCC TGCCACGCGGGAGGCCCGGGTTCGATTCCCG |
| 108 | Gly_GCC_chr1:16149 3637-161493707 (-) | GCATTGGTGGTTCAGTGGTAGAATTCTCGCCT GCCACGCGGGAGGCCCGGGTTCGATTCCCGG |
| 109 | Gly_GCC_chr16:7081 2114-70812184 (-) | GCATTGGTGGTTCAGTGGTAGAATTCTCGCCT GCCACGCGGGAGGCCCGGGTTTGATTCCCGG |
| 110 | Gly_GCC_chr1:16145 0356-161450426 (+) | GCATAGGTGGTTCAGTGGTAGAATTCTTGCC TGCCACGCAGGAGGCCCAGGTTTGATTCCTG |
| 111 | Gly_GCC_chr16:7082 2597-70822667 (+) | GCATTGGTGGTTCAGTGGTAGAATTCTCGCCT GCCATGCGGGCGGCCGGGCTTCGATTCCTGG |
| 112 | Gly_TCC_chr19:4724 082-4724153 (+) | GCGTTGGTGGTATAGTGGTTAGCATAGCTGC CTTCCAAGCAGTTGACCCGGGTTCGATTCCC |
| 113 | Gly_TCC_chr1:14539 7864-145397935 (-) | GCGTTGGTGGTATAGTGGTGAGCATAGCTGC CTTCCAAGCAGTTGACCCGGGTTCGATTCCC |
| 114 | Gly_TCC_chr17:8124 866-8124937 (+) | GCGTTGGTGGTATAGTGGTAAGCATAGCTGC CTTCCAAGCAGTTGACCCGGGTTCGATTCCC |
| 115 | Gly_TCC_chr1:16140 9961-161410032 (-) | GCGTTGGTGGTATAGTGGTGAGCATAGTTGC CTTCCAAGCAGTTGACCCGGGCTCGATTCCC |
| 116 | His_GTG_chr1:14539 6881-145396952 (-) | GCCGTGATCGTATAGTGGTTAGTACTCTGCGT TGTGGCCGCAGCAACCTCGGTTCGAATCCGA |
| 117 | His_GTG_chr1:14915 5828-149155899 (-) | GCCATGATCGTATAGTGGTTAGTACTCTGCG CTGTGGCCGCAGCAACCTCGGTTCGAATCCG |
| 118 | Ile_AAT_chr6:581492 54-58149327 (+) | GGCCGGTTAGCTCAGTTGGTTAGAGCGTGGC GCTAATAACGCCAAGGTCGCGGGTTCGATCC |
| 119 | Ile_AAT_chr6:276559 67-27656040 (+) | GGCCGGTTAGCTCAGTTGGTTAGAGCGTGGT GCTAATAACGCCAAGGTCGCGGGTTCGATCC |
| 120 | Ile_AAT_chr6:272429 90-27243063 (-) | GGCTGGTTAGCTCAGTTGGTTAGAGCGTGGT GCTAATAACGCCAAGGTCGCGGGTTCGATCC |
| 121 | Ile_AAT_chr17:81303 09-8130382 (-) | GGCCGGTTAGCTCAGTTGGTTAGAGCGTGGT GCTAATAACGCCAAGGTCGCGGGTTCGAACC |
| 122 | Ile_AAT_chr6:265543 50-26554423 (+) | GGCCGGTTAGCTCAGTTGGTTAGAGCGTGGT GCTAATAACGCCAAGGTCGCGGGTTCGATCC |

TABLE 1-continued

| List of tRNA Sequences | | |
|---|---|---|
| SEQ ID NO | tRNA name | tRNA sequence |
| 123 | Ile_AAT_chr6:267452 55-26745328 (-) | GGCCGGTTAGCTCAGTTGGTTAGAGCGTGGT GCTAATAACGCTAAGGTCGCGGGTTCGATCC |
| 124 | Ile_AAT_chr6:267212 21-26721294 (-) | GGCCGGTTAGCTCAGTTGGTCAGAGCGTGGT GCTAATAACGCCAAGGTCGCGGGTTCGATCC |
| 125 | Ile_AAT_chr6:276363 62-27636435 (+) | GGCCGGTTAGCTCAGTCGGCTAGAGCGTGGT GCTAATAACGCCAAGGTCGCGGGTTCGATCC |
| 126 | Ile_AAT_chr6:272417 39-27241812 (+) | GGCTGGTTAGTTCAGTTGGTTAGAGCGTGGT GCTAATAACGCCAAGGTCGTGGGTTCGATCC |
| 127 | Ile_GAT_chrX:37564 18-3756491 (-) | GGCCGGTTAGCTCAGTTGGTAAGAGCGTGGT GCTGATAACACCAAGGTCGCGGGCTCGACTC |
| 128 | Ile_TAT_chr19:39902 808-39902900 (-) | GCTCCAGTGGCGCAATCGGTTAGCGCGCGGT ACTTATATGACAGTGCGAGCGGAGCAATGCC |
| 129 | Ile_TAT_chr2:430376 76-43037768 (+) | GCTCCAGTGGCGCAATCGGTTAGCGCGCGGT ACTTATACAGCAGTACATGCAGAGCAATGCC |
| 130 | Ile_TAT_chr6:269881 25-26988218 (+) | GCTCCAGTGGCGCAATCGGTTAGCGCGCGGT ACTTATATGGCAGTATGTGTGCGAGTGATGC |
| 131 | Ile_TAT_chr6:275992 00-27599293 (+) | GCTCCAGTGGCGCAATCGGTTAGCGCGCGGT ACTTATACAACAGTATATGTGCGGGTGATGC |
| 132 | Ile_TAT_chr6:285053 67-28505460 (+) | GCTCCAGTGGCGCAATCGGTTAGCGCGCGGT ACTTATAAGACAGTGCACCTGTGAGCAATGC |
| 133 | Leu_AAG_chr5:1805 24474-180524555 (-) | GGTAGCGTGGCCGAGCGGTCTAAGGCGCTGG ATTAAGGCTCCAGTCTCTTCGGAGGCGTGGG |
| 134 | Leu_AAG_chr5:1806 14701-180614782 (+) | GGTAGCGTGGCCGAGCGGTCTAAGGCGCTGG ATTAAGGCTCCAGTCTCTTCGGGGGCGTGGG |
| 135 | Leu_AAG_chr6:2895 6779-28956860 (+) | GGTAGCGTGGCCGAGCGGTCTAAGGCGCTGG ATTAAGGCTCCAGTCTCTTCGGGGGCGTGGG |
| 136 | Leu_AAG_chr6:2844 6400-28446481 (-) | GGTAGCGTGGCCGAGTGGTCTAAGACGCTGG ATTAAGGCTCCAGTCTCTTCGGGGGCGTGGG |
| 137 | Leu_CAA_chr6:28864 000-28864105 (-) | GTCAGGATGGCCGAGTGGTCTAAGGCGCCAG ACTCAAGCTAAGCTTCCTCCGCGGTGGGGAT |
| 138 | Leu_CAA_chr6:28908 830-28908934 (+) | GTCAGGATGGCCGAGTGGTCTAAGGCGCCAG ACTCAAGCTTGGCTTCCTCGTGTTGAGGATTC |
| 139 | Leu_CAA_chr6:27573 417-27573524 (-) | GTCAGGATGGCCGAGTGGTCTAAGGCGCCAG ACTCAAGCTTACTGCTTCCTGTGTTCGGGTCT |
| 140 | Leu_CAA_chr6:27570 348-27570454 (-) | GTCAGGATGGCCGAGTGGTCTAAGGCGCCAG ACTCAAGTTGCTACTTCCCAGGTTTGGGGCTT |
| 141 | Leu_CAA_chr1:24916 8054-249168159 (+) | GTCAGGATGGCCGAGTGGTCTAAGGCGCCAG ACTCAAGGTAAGCACCTTGCCTGCGGGCTTT |
| 142 | Leu_CAA_chr11:9296 790-9296863 (+) | GCCTCCTTAGTGCAGTAGGTAGCGCATCAGT CTCAAAATCTGAATGGTCCTGAGTTCAAGCC |
| 143 | Leu_CAA_chr1:16158 1736-161581819 (-) | GTCAGGATGGCCGAGCAGTCTTAAGGCGCTG CGTTCAAATCGCACCCTCCGCTGGAGGCGTG |
| 144 | Leu_CAG_chr1:16141 1323-161411405 (+) | GTCAGGATGGCCGAGCGGTCTAAGGCGCTGC GTTCAGGTCGCAGTCTCCCCTGGAGGCGTGG |
| 145 | Leu_CAG_chr16:5733 3863-57333945 (+) | GTCAGGATGGCCGAGCGGTCTAAGGCGCTGC GTTCAGGTCGCAGTCTCCCCTGGAGGCGTGG |
| 146 | Leu_TAA_chr6:14453 7684-144537766 (+) | ACCAGGATGGCCGAGTGGTTAAGGCGTTGGA CTTAAGATCCAATGGACATATGTCCGCGTGG |

TABLE 1-continued

| SEQ ID NO | tRNA name | tRNA sequence |
|---|---|---|
| | List of tRNA Sequences | |
| 147 | Leu_TAA_chr6:27688898-27688980 (-) | ACCGGGATGGCCGAGTGGTTAAGGCGTTGGACTTAAGATCCAATGGGCTGGTGCCCGCGTGG |
| 148 | Leu_TAA_chr11:59319228-59319310 (+) | ACCAGAATGGCCGAGTGGTTAAGGCGTTGGACTTAAGATCCAATGGATTCATATCCGCGTGG |
| 149 | Leu_TAA_chr6:27198334-27198416 (-) | ACCGGGATGGCTGAGTGGTTAAGGCGTTGGACTTAAGATCCAATGGACAGGTGTCCGCGTGG |
| 150 | Leu_TAG_chr17:8023632-8023713 (-) | GGTAGCGTGGCCGAGCGGTCTAAGGCGCTGGATTTAGGCTCCAGTCTCTTCGGAGGCGTGGG |
| 151 | Leu_TAG_chr14:21093529-21093610 (+) | GGTAGTGTGGCCGAGCGGTCTAAGGCGCTGGATTTAGGCTCCAGTCTCTTCGGGGGCGTGGG |
| 152 | Leu_TAG_chr16:22207032-22207113 (-) | GGTAGCGTGGCCGAGTGGTCTAAGGCGCTGGATTTAGGCTCCAGTCATTTCGATGGCGTGGGT |
| 153 | Lys_CTT_chr14:58706613-58706685 (-) | GCCCGGCTAGCTCAGTCGGTAGAGCATGGGACTCTTAATCCCAGGGTCGTGGGTTCGAGCCC |
| 154 | Lys_CTT_chr19:36066750-36066822 (+) | GCCCAGCTAGCTCAGTCGGTAGAGCATAAGACTCTTAATCTCAGGGTTGTGGATTCGTGCCCC |
| 155 | Lys_CTT_chr19:52425393-52425466 (-) | GCAGCTAGCTCAGTCGGTAGAGCATGAGACTCTTAATCTCAGGGTCATGGGTTCGTGCCCCAT |
| 156 | Lys_CTT_chr1:145395522-145395594 (-) | GCCCGGCTAGCTCAGTCGGTAGAGCATGAGACTCTTAATCTCAGGGTCGTGGGTTCGAGCCCC |
| 157 | Lys_CTT_chr16:3207406-3207478 (-) | GCCCGGCTAGCTCAGTCGGTAGAGCATGAGACCCTTAATCTCAGGGTCGTGGGTTCGAGCCC |
| 158 | Lys_CTT_chr16:3241501-3241573 (+) | GCCCGGCTAGCTCAGTCGGTAGAGCATGGGACTCTTAATCTCAGGGTCGTGGGTTCGAGCCCC |
| 159 | Lys_CTT_chr16:3230555-3230627 (-) | GCCCGGCTAGCTCAGTCGATAGAGCATGAGACTCTTAATCTCAGGGTCGTGGGTTCGAGCCG |
| 160 | Lys_CTT_chr1:55423542-55423614 (-) | GCCCAGCTAGCTCAGTCGGTAGAGCATGAGACTCTTAATCTCAGGGTCATGGGTTTGAGCCCC |
| 161 | Lys_CTT_chr16:3214939-3215011 (+) | GCCTGGCTAGCTCAGTCGGCAAAGCATGAGACTCTTAATCTCAGGGTCGTGGGCTCGAGCTCC |
| 162 | Lys_CTT_chr5:26198539-26198611 (-) | GCCCGACTACCTCAGTCGGTGGAGCATGGGACTCTTCATCCCAGGGTTGTGGGTTCGAGCCCC |
| 163 | Lys_TTT_chr16:73512216-73512288 (-) | GCCTGGATAGCTCAGTTGGTAGAGCATCAGACTTTTAATCTGAGGGTCCAGGGTTCAAGTCCC |
| 164 | Lys_TTT_chr12:27843306-27843378 (+) | ACCCAGATAGCTCAGTCAGTAGAGCATCAGACTTTTAATCTGAGGGTCCAAGGTTCATGTCCC |
| 165 | Lys_TTT_chr11:122430655-122430727 (+) | GCCTGGATAGCTCAGTTGGTAGAGCATCAGACTTTTAATCTGAGGGTCCAGGGTTCAAGTCCC |
| 166 | Lys_TTT_chr1:204475655-204475727 (+) | GCCCGGATAGCTCAGTCGGTAGAGCATCAGACTTTTAATCTGAGGGTCCAGGGTTCAAGTCCC |
| 167 | Lys_TTT_chr6:27559593-27559665 (-) | GCCTGGATAGCTCAGTCGGTAGAGCATCAGACTTTTAATCTGAGGGTCCAGGGTTCAAGTCCC |
| 168 | Lys_TTT_chr11:59323902-59323974 (+) | GCCCGGATAGCTCAGTCGGTAGAGCATCAGACTTTTAATCTGAGGGTCCGGGGTTCAAGTCCC |
| 169 | Lys_TTT_chr6:27302769-27302841 (-) | GCCTGGGTAGCTCAGTCGGTAGAGCATCAGACTTTTAATCTGAGGGTCCAGGGTTCAAGTCCC |
| 170 | Lys_TTT_chr6:28715521-28715593 (+) | GCCTGGATAGCTCAGTTGGTAGAACATCAGACTTTTAATCTGACGGTGCAGGGTTCAAGTCCC |

TABLE 1-continued

| | List of tRNA Sequences | |
|---|---|---|
| SEQ ID NO | tRNA name | tRNA sequence |
| 171 | Met_CAT_chr8:12416 9470-124169542 (-) | GCCTCGTTAGCGCAGTAGGTAGCGCGTCAGT CTCATAATCTGAAGGTCGTGAGTTCGATCCTC |
| 172 | Met_CAT_chr16:7146 0396-71460468 (+) | GCCCTCTTAGCGCAGTGGGCAGCGCGTCAGT CTCATAATCTGAAGGTCCTGAGTTCGAGCCT |
| 173 | Met_CAT_chr6:28912 352-28912424 (+) | GCCTCCTTAGCGCAGTAGGCAGCGCGTCAGT CTCATAATCTGAAGGTCCTGAGTTCGAACCT |
| 174 | Met_CAT_chr6:26735 574-26735646 (-) | GCCCTCTTAGCGCAGCGGGCAGCGCGTCAGT CTCATAATCTGAAGGTCCTGAGTTCGAGCCT |
| 175 | Met_CAT_chr6:26701 712-26701784 (+) | GCCCTCTTAGCGCAGCTGGCAGCGCGTCAGT CTCATAATCTGAAGGTCCTGAGTTCAAGCCT |
| 176 | Met_CAT_chr16:8741 7628-87417700 (-) | GCCTCGTTAGCGCAGTAGGCAGCGCGTCAGT CTCATAATCTGAAGGTCGTGAGTTCGAGCCT |
| 177 | Met_CAT_chr6:58168 492-58168564 (-) | GCCCTCTTAGTGCAGCTGGCAGCGCGTCAGT TTCATAATCTGAAAGTCCTGAGTTCAAGCCTC |
| 178 | Phe_GAA_chr6:28758 499-28758571 (-) | GCCGAAATAGCTCAGTTGGGAGAGCGTTAGA CTGAAGATCTAAAGGTCCCTGGTTCGATCCC |
| 179 | Phe_GAA_chr11:5933 3853-59333925 (-) | GCCGAAATAGCTCAGTTGGGAGAGCGTTAGA CTGAAGATCTAAAGGTCCCTGGTTCAATCCC |
| 180 | Phe_GAA_chr6:28775 610-28775682 (-) | GCCGAGATAGCTCAGTTGGGAGAGCGTTAGA CTGAAGATCTAAAGGTCCCTGGTTCAATCCC |
| 181 | Phe_GAA_chr6:28791 093-28791166 (-) | GCCGAAATAGCTCAGTTGGGAGAGCGTTAGA CCGAAGATCTTAAAGGTCCCTGGTTCAATCC |
| 182 | Phe_GAA_chr6:28731 374-28731447 (-) | GCTGAAATAGCTCAGTTGGGAGAGCGTTAGA CTGAAGATCTTAAAGTTCCCTGGTTCAACCCT |
| 183 | Pro_AGG_chr16:3241 989-3242060 (+) | GGCTCGTTGGTCTAGGGGTATGATTCTCGCTT AGGATGCGAGAGGTCCCGGGTTCAAATCCCG |
| 184 | Pro_AGG_chr1:16768 4725-167684796 (-) | GGCTCGTTGGTCTAGGGGTATGATTCTCGCTT AGGGTGCGAGAGGTCCCGGGTTCAAATCCCG |
| 185 | Pro_CGG_chr1:16768 3962-167684033 (+) | GGCTCGTTGGTCTAGGGGTATGATTCTCGCTT CGGGTGCGAGAGGTCCCGGGTTCAAATCCCG |
| 186 | Pro_CGG_chr6:27059 521-27059592 (+) | GGCTCGTTGGTCTAGGGGTATGATTCTCGCTT CGGGTGTGAGAGGTCCCGGGTTCAAATCCCG |
| 187 | Pro_TGG_chr14:2110 1165-21101236 (+) | GGCTCGTTGGTCTAGTGGTATGATTCTCGCTT TGGGTGCGAGAGGTCCCGGGTTCAAATCCCG |
| 188 | Pro_TGG_chr11:7594 6869-75946940 (-) | GGCTCGTTGGTCTAGGGGTATGATTCTCGGTT TGGGTCCGAGAGGTCCCGGGTTCAAATCCCG |
| 189 | Pro_TGG_chr5:18061 5854-180615925 (-) | GGCTCGTTGGTCTAGGGGTATGATTCTCGCTT TGGGTGCGAGAGGTCCCGGGTTCAAATCCCG |
| 190 | Ser_TCA_chr19:4598 1859-45981945 (-) | GCCCGGATGATCCTCAGTGGTCTGGGGTGCA GGCTTCAAACCTGTAGCTGTCTAGCGACAGA |
| 191 | Ser_TCA_chr22:4454 6537-44546620 (+) | GCTCGGATGATCCTCAGTGGTCTGGGGTGCA GGCTTCAAACCTGTAGCTGTCTAGTGACAGA |
| 192 | Ser_AGA_chr6:27509 554-27509635 (-) | GTAGTCGTGGCCGAGTGGTTAAGGCGATGGA CTAGAAATCCATTGGGGTTTCCCCGCGCAGG |
| 193 | Ser_AGA_chr6:26327 817-26327898 (+) | GTAGTCGTGGCCGAGTGGTTAAGGCGATGGA CTAGAAATCCATTGGGGTCTCCCCGCGCAGG |
| 194 | Ser_AGA_chr6:27499 987-27500068 (+) | GTAGTCGTGGCCGAGTGGTTAAGGCGATGGA CTAGAAATCCATTGGGGTTTCCCCACGCAGG |

TABLE 1-continued

| List of tRNA Sequences | | |
|---|---|---|
| SEQ ID NO | tRNA name | tRNA sequence |
| 195 | Ser_AGA_chr6:27521192-27521273 (-) | GTAGTCGTGGCCGAGTGGTTAAGGTGATGGACTAGAAACCCATTGGGGTCTCCCCGCGCAGG |
| 196 | Ser_CGA_chr17:8042199-8042280 (-) | GCTGTGATGGCCGAGTGGTTAAGGCGTTGGACTCGAAATCCAATGGGGTCTCCCCGCGCAGG |
| 197 | Ser_CGA_chr6:27177628-27177709 (+) | GCTGTGATGGCCGAGTGGTTAAGGCGTTGGACTCGAAATCCAATGGGGTCTCCCCGCGCAGG |
| 198 | Ser_CGA_chr6:27640229-27640310 (-) | GCTGTGATGGCCGAGTGGTTAAGGTGTTGGACTCGAAATCCAATGGGGGTTCCCCGCGCAGG |
| 199 | Ser_CGA_chr12:56584148-56584229 (+) | GTCACGGTGGCCGAGTGGTTAAGGCGTTGGACTCGAAATCCAATGGGGTTTCCCCGCACAGG |
| 200 | Ser_GCT_chr6:27065085-27065166 (+) | GACGAGGTGGCCGAGTGGTTAAGGCGATGGACTGCTAATCCATTGTGCTCTGCACGCGTGG |
| 201 | Ser_GCT_chr6:27265775-27265856 (+) | GACGAGGTGGCCGAGTGGTTAAGGCGATGGACTGCTAATCCATTGTGCTCTGCACGCGTGG |
| 202 | Ser_GCT_chr11:66115591-66115672 (+) | GACGAGGTGGCCGAGTGGTTAAGGCGATGGACTGCTAATCCATTGTGCTTTGCACGCGTGGG |
| 203 | Ser_GCT_chr6:28565117-28565198 (-) | GACGAGGTGGCCGAGTGGTTAAGGCGATGGACTGCTAATCCATTGTGCTCTGCACGCGTGG |
| 204 | Ser_GCT_chr6:28180815-28180896 (+) | GACGAGGTGGCCGAGTGGTTAAGGCGATGGACTGCTAATCCATTGTGCTCTGCACACGTGG |
| 205 | Ser_GCT_chr6:26305718-26305801 (-) | GGAGAGGCCTGGCCGAGTGGTTAAGGCGATGGACTGCTAATCCATTGTGCTCTGCACGCGTG |
| 206 | Ser_TGA_chr10:69524261-69524342 (+) | GCAGCGATGGCCGAGTGGTTAAGGCGTTGGACTTGAAATCCAATGGGGTCTCCCCGCGCAGG |
| 207 | Ser_TGA_chr6:27513468-27513549 (+) | GTAGTCGTGGCCGAGTGGTTAAGGCGATGGACTTGAAATCCATTGGGGTTTCCCCGCGCAGG |
| 208 | Ser_TGA_chr6:26312824-26312905 (-) | GTAGTCGTGGCCGAGTGGTTAAGGCGATGGACTTGAAATCCATTGGGGTCTCCCCGCGCAGG |
| 209 | Ser_TGA_chr6:27473607-27473688 (-) | GTAGTCGTGGCCGAGTGGTTAAGGCGATGGACTTGAAATCCATTGGGGTTTCCCCGCGCAGG |
| 210 | Thr_AGT_chr17:8090478-8090551 (+) | GGCGCCGTGGCTTAGTTGGTTAAAGCGCCTGTCTAGTAAACAGGAGATCCTGGGTTCGAATC |
| 211 | Thr_AGT_chr6:26533145-26533218 (-) | GGCTCCGTGGCTTAGCTGGTTAAAGCGCCTGTCTAGTAAACAGGAGATCCTGGGTTCGAATC |
| 212 | Thr_AGT_chr6:28693795-28693868 (+) | GGCTCCGTAGCTTAGTTGGTTAAAGCGCCTGTCTAGTAAACAGGAGATCCTGGGTTCGACTC |
| 213 | Thr_AGT_chr6:27694473-27694546 (+) | GGCTTCGTGGCTTAGCTGGTTAAAGCGCCTGTCTAGTAAACAGGAGATCCTGGGTTCGAATC |
| 214 | Thr_AGT_chr17:8042770-8042843 (-) | GGCGCCGTGGCTTAGCTGGTTAAAGCGCCTGTCTAGTAAACAGGAGATCCTGGGTTCGAATC |
| 215 | Thr_AGT_chr6:27130050-27130123 (+) | GGCCCTGTGGCTTAGCTGGTCAAAGCGCCTGTCTAGTAAACAGGAGATCCTGGGTTCGAATC |
| 216 | Thr_CGT_chr6:28456770-28456843 (-) | GGCTCTATGGCTTAGTTGGTTAAAGCGCCTGTCTCGTAAACAGGAGATCCTGGGTTCGACTCC |
| 217 | Thr_CGT_chr16:14379750-14379821 (+) | GGCGCGGTGGCCAAGTGGTAAGGCGTCGGTCTCGTAAACCGAAGATCACGGGTTCGAACCCC |
| 218 | Thr_CGT_chr6:28615984-28616057 (-) | GGCTCTGTGGCTTAGTTGGCTAAAGCGCCTGTCTCGTAAACAGGAGATCCTGGGTTCGAATC |

TABLE 1-continued

| List of tRNA Sequences | | |
| --- | --- | --- |
| SEQ ID NO | tRNA name | tRNA sequence |
| 219 | Thr_CGT_chr17:2987 7093-29877164 (+) | GGCGCGGTGGCCAAGTGGTAAGGCGTCGGTC TCGTAAACCGAAGATCGCGGGTTCGAACCCC |
| 220 | Thr_CGT_chr6:27586 135-27586208 (+) | GGCCCTGTAGCTCAGCGGTTGGAGCGCTGGT CTCGTAAACCTAGGGGTCGTGAGTTCAAATC |
| 221 | Thr_TGT_chr6:28442 329-28442402 (-) | GGCTCTATGGCTTAGTTGGTTAAAGCGCCTGT CTTGTAAACAGGAGATCCTGGGTTCGAATCC |
| 222 | Thr_TGT_chr1:22263 8347-222638419 (+) | GGCTCCATAGCTCAGTGGTTAGAGCACTGGT CTTGTAAACCAGGGGTCGCGAGTTCGATCCT |
| 223 | Thr_TGT_chr14:2108 1949-21082021 (-) | GGCTCCATAGCTCAGGGGTTAGAGCGCTGGT CTTGTAAACCAGGGGTCGCGAGTTCAATTCT |
| 224 | Thr_TGT_chr14:2109 9319-21099391 (-) | GGCTCCATAGCTCAGGGGTTAGAGCACTGGT CTTGTAAACCAGGGGTCGCGAGTTCAAATCT |
| 225 | Thr_TGT_chr14:2114 9849-21149921 (+) | GGCCCTATAGCTCAGGGGTTAGAGCACTGGT CTTGTAAACCAGGGGTCGCGAGTTCAAATCT |
| 226 | Thr_TGT_chr5:18061 8687-180618758 (-) | GGCTCCATAGCTCAGGGGTTAGAGCACTGGT CTTGTAAACCAGGGTCGCGAGTTCAAATCTC |
| 227 | Trp_CCA_chr17:8124 187-8124258 (-) | GGCCTCGTGGCGCAACGGTAGCGCGTCTGAC TCCAGATCAGAAGGTTGCGTGTTCAAATCAC |
| 228 | Trp_CCA_chr17:1941 1494-19411565 (+) | GACCTCGTGGCGCAATGGTAGCGCGTCTGAC TCCAGATCAGAAGGTTGCGTGTTCAAGTCAC |
| 229 | Trp_CCA_chr6:26319 330-26319401 (-) | GACCTCGTGGCGCAACGGTAGCGCGTCTGAC TCCAGATCAGAAGGTTGCGTGTTCAAATCAC |
| 230 | Trp_CCA_chr12:9889 8030-98898101 (+) | GACCTCGTGGCGCAACGGTAGCGCGTCTGAC TCCAGATCAGAAGGCTGCGTGTTCGAATCAC |
| 231 | Trp_CCA_chr7:99067 307-99067378 (+) | GACCTCGTGGCGCAACGGCAGCGCGTCTGAC TCCAGATCAGAAGGTTGCGTGTTCAAATCAC |
| 232 | Tyr_ATA_chr2:21911 0549-219110641 (+) | CCTTCAATAGTTCAGCTGGTAGAGCAGAGGA CTATAGCTACTTCCTCAGTAGGAGACGTCCTT |
| 233 | Tyr_GTA_chr6:26569 086-26569176 (+) | CCTTCGATAGCTCAGTTGGTAGAGCGGAGGA CTGTAGTTGGCTGTGTCCTTAGACATCCTTAG |
| 234 | Tyr_GTA_chr2:27273 650-27273738 (+) | CCTTCGATAGCTCAGTTGGTAGAGCGGAGGA CTGTAGTGGATAGGGCGTGGCAATCCTTAGG |
| 235 | Tyr_GTA_chr6:26577 332-26577420 (+) | CCTTCGATAGCTCAGTTGGTAGAGCGGAGGA CTGTAGGCTCATTAAGCAAGGTATCCTTAGG |
| 236 | Tyr_GTA_chr14:2112 5623-21125716 (-) | CCTTCGATAGCTCAGCTGGTAGAGCGGAGGA CTGTAGATTGTATAGACATTTGCGGACATCCT |
| 237 | Tyr_GTA_chr8:67025 602-67025694 (+) | CCTTCGATAGCTCAGCTGGTAGAGCGGAGGA CTGTAGCTACTTCCTCAGCAGGAGACATCCTT |
| 238 | Tyr_GTA_chr8:67026 223-67026311 (+) | CCTTCGATAGCTCAGCTGGTAGAGCGGAGGA CTGTAGGCGCGCGCCCGTGGCCATCCTTAGG |
| 239 | Tyr_GTA_chr14:2112 1258-21121351 (-) | CCTTCGATAGCTCAGCTGGTAGAGCGGAGGA CTGTAGCCTGTAGAAACATTTGTGGACATCC |
| 240 | Tyr_GTA_chr14:2113 1351-21131444 (-) | CCTTCGATAGCTCAGCTGGTAGAGCGGAGGA CTGTAGATTGTACAGACATTTGCGGACATCC |
| 241 | Tyr_GTA_chr14:2115 1432-21151520 (+) | CCTTCGATAGCTCAGCTGGTAGAGCGGAGGA CTGTAGTACTTAATGTGTGGTCATCCTTAGGT |
| 242 | Tyr_GTA_chr6:26595 102-26595190 (+) | CCTTCGATAGCTCAGCTGGTAGAGCGGAGGA CTGTAGGGGTTTGAATGTGGTCATCCTTAGGT |

TABLE 1-continued

| List of tRNA Sequences | | |
| --- | --- | --- |
| SEQ ID NO | tRNA name | tRNA sequence |
| 243 | Tyr_GTA_chr14:2112 8117-21128210 (-) | CCTTCGATAGCTCAGCTGGTAGAGCGGAGGA CTGTAGACTGCGGAAACGTTTGTGGACATCC |
| 244 | Tyr_GTA_chr6:26575 798-26575887 (+) | CTTTCGATAGCTCAGTTGGTAGAGCGGAGGA CTGTAGGTTCATTAAACTAAGGCATCCTTAG |
| 245 | Tyr_GTA_chr8:66609 532-66609619 (-) | TCTTCAATAGCTCAGCTGGTAGAGCGGAGGA CTGTAGGTGCACGCCCGTGGCCATTCTTAGG |
| 246 | Val_AAC_chr3:16949 0018-169490090 (+) | GTTTCCGTAGTGTAGTGGTTATCACGTTCGCC TAACACGCGAAAGGTCCCCGGTTCGAAACCG |
| 247 | Val_AAC_chr5:18061 5416-180615488 (-) | GTTTCCGTAGTGTAGTGGTCATCACGTTCGCC TAACACGCGAAAGGTCCCCGGTTCGAAACCG |
| 248 | Val_AAC_chr6:27618 707-27618779 (-) | GTTTCCGTAGTGTAGTGGTTATCACGTTCGCC TAACACGCGAAAGGTCCCTGGATCAAAACCA |
| 249 | Val_AAC_chr6:27648 885-27648957 (-) | GTTTCCGTAGTGTAGTGGTTATCACGTTCGCC TAACACGCGAAAGGTCCGCGGTTCGAAACCG |
| 250 | Val_AAC_chr6:27203 288-27203360 (+) | GTTTCCGTAGTGTAGTGGTTATCACGTTTGCC TAACACGCGAAAGGTCCCCGGTTCGAAACCG |
| 251 | Val_AAC_chr6:28703 206-28703277 (-) | GGGGGTGTAGCTCAGTGGTAGAGCGTATGCT TAACATTCATGAGGCTCTGGGTTCGATCCCC |
| 252 | Val_CAC_chr1:16136 9490-161369562 (-) | GTTTCCGTAGTGTAGTGGTTATCACGTTCGCC TCACACGCGAAAGGTCCCCGGTTCGAAACCG |
| 253 | Val_CAC_chr6:27248 049-27248121 (-) | GCTTCTGTAGTGTAGTGGTTATCACGTTCGCC TCACACGCGAAAGGTCCCCGGTTCGAAACCG |
| 254 | Val_CAC_chr19:4724 647-4724719 (-) | GTTTCCGTAGTGTAGCGGTTATCACATTCGCC TCACACGCGAAAGGTCCCCGGTTCGATCCCG |
| 255 | Val_CAC_chr1:14929 8555-149298627 (-) | GTTTCCGTAGTGTAGTGGTTATCACGTTCGCC TCACACGCGAAAGGTCCCCGGTTCGAAACTG |
| 256 | Val_CAC_chr1:14968 4088-149684161 (-) | GTTTCCGTAGTGTAGTGGTTATCACGTTCGCC TCACACGCGTAAAGGTCCCCGGTTCGAAACC |
| 257 | Val_CAC_chr6:27173 867-27173939 (-) | GTTTCCGTAGTGGAGTGGTTATCACGTTCGCC TCACACGCGAAAGGTCCCCGGTTTGAAACCA |
| 258 | Val_TAC_chr11:5931 8102-59318174 (-) | GGTTCCATAGTGTAGTGGTTATCACGTCTGCT TTACACGCAGAAGGTCCTGGGTTCGAGCCCC |
| 259 | Val_TAC_chr11:5931 8460-59318532 (-) | GGTTCCATAGTGTAGCGGTTATCACGTCTGCT TTACACGCAGAAGGTCCTGGGTTCGAGCCCC |
| 260 | Val_TAC_chr10:5895 674-5895746 (-) | GGTTCCATAGTGTAGTGGTTATCACATCTGCT TTACACGCAGAAGGTCCTGGGTTCAAGCCCC |
| 261 | Val_TAC_chr6:27258 405-27258477 (+) | GTTTCCGTGGTGTAGTGGTTATCACATTCGCC TTACACGCGAAAGGTCCTCGGGTCGAAACCG |
| 262 | iMet_CAT_chr1:1536 43726-153643797 (+) | AGCAGAGTGGCGCAGCGGAAGCGTGCTGGG CCCATAACCCAGAGGTCGATGGATCGAAACC |
| 263 | iMet_CAT_chr6:2774 5664-27745735 (+) | AGCAGAGTGGCGCAGCGGAAGCGTGCTGGG CCCATAACCCAGAGGTCGATGGATCTAAACC |
| 264 | Glu_TTC_chr1:16861 773-16861845 (-) | TCCCTGGTGGTCTAGTGGCTAGGATTCGGCG CTTTCACCGCCGCGGCCCGGGTTCGATTCCCG |
| 265 | Gly_CCC_chr1:17004 765-17004836 (-) | GCGTTGGTGGTTTAGTGGTAGAATTCTCGCCT CCCATGCGGGAGACCCGGGTTCAATTCCCGG |
| 266 | Gly_CCC_chr1:17053 779-17053850 (+) | GGCCTTGGTGGTGCAGTGGTAGAATTCTCGC CTCCCACGTGGGAGACCCGGGTTCAATTCCC |

TABLE 1-continued

| List of tRNA Sequences | | |
|---|---|---|
| SEQ ID NO | tRNA name | tRNA sequence |
| 267 | Glu_TTC_chr1:17199 077-17199149 (+) | GTCCCTGGTGGTCTAGTGGCTAGGATTCGGC GCTTTCACCGCCGCGGCCCGGGTTCGATTCCC |
| 268 | Asn_GTT_chr1:17216 171-17216245 (+) | TGTCTCTGTGGCGCAATCGGTTAGCGCGTTCG GCTGTTAACCGAAAGATTGGTGGTTCGAGCC |
| 269 | Arg_TCT_chr1:94313 128-94313213 (+) | TGGCTCCGTGGCGCAATGGATAGCGCATTGG ACTTCTAGAGGCTGAAGGCATTCAAAGGTTC |
| 270 | Lys_CTT_chr1:14539 5521-145395594 (-) | GCCCGGCTAGCTCAGTCGGTAGAGCATGAGA CTCTTAATCTCAGGGTCGTGGGTTCGAGCCCC |
| 271 | His_GTG_chr1:14539 6880-145396952 (-) | GCCGTGATCGTATAGTGGTTAGTACTCTGCGT TGTGGCCGCAGCAACCTCGGTTCGAATCCGA |
| 272 | Gly_TCC_chr1:14539 7863-145397935 (-) | GCGTTGGTGGTATAGTGGTGAGCATAGCTGC CTTCCAAGCAGTTGACCCGGGTTCGATTCCC |
| 273 | Glu_CTC_chr1:14539 9232-145399304 (-) | TCCCTGGTGGTCTAGTGGTTAGGATTCGGCG CTCTCACCGCCGCGGCCCGGGTTCGATTCCC |
| 274 | Gln_CTG_chr1:14596 3303-145963375 (+) | AGGTTCCATGGTGTAATGGTGAGCACTCTGG ACTCTGAATCCAGCGATCCGAGTTCGAGTCT |
| 275 | Asn_GTT_chr1:14800 0804-148000878 (+) | TGTCTCTGTGGCGTAGTCGGTTAGCGCGTTCG GCTGTTAACCGAAAAGTTGGTGGTTCGAGCC |
| 276 | Asn_GTT_chr1:14824 8114-148248188 (+) | TGTCTCTGTGGCGCAATCGGTTAGCGCGTTCG GCTGTTAACCGAAAGGTTGGTGGTTCGAGCC |
| 277 | Asn_GTT_chr1:14859 8313-148598387 (-) | GTCTCTGTGGCGCAATCGGTTAGCGCATTCG GCTGTTAACCGAAAGGTTGGTGGTTCGAGCC |
| 278 | Asn_GTT_chr1:14923 0569-149230643 (-) | GTCTCTGTGGCGCAATGGGTTAGCGCGTTCG GCTGTTAACCGAAAGGTTGGTGGTTCGAGCC |
| 279 | Val_CAC_chr1:14929 4665-149294736 (-) | GCACTGGTGGTTCAGTGGTAGAATTCTCGCC TCACACGCGGGACACCCGGGTTCAATTCCCG |
| 280 | Val_CAC_chr1:14929 8554-149298627 (-) | GTTTCCGTAGTGTAGTGGTTATCACGTTCGCC TCACACGCGAAAGGTCCCCGGTTCGAAACTG |
| 281 | Gly_CCC_chr1:14968 0209-149680280 (-) | GCACTGGTGGTTCAGTGGTAGAATTCTCGCC TCCCACGCGGGAGACCCGGGTTTAATTCCCG |
| 282 | Val_CAC_chr1:14968 4087-149684161 (-) | GTTTCCGTAGTGTAGTGGTTATCACGTTCGCC TCACACGCGTAAAGGTCCCCGGTTCGAAACC |
| 283 | Met_CAT_chr1:15364 3725-153643797 (+) | TAGCAGAGTGGCGCAGCGGAAGCGTGCTGG GCCCATAACCCAGAGGTCGATGGATCGAAAC |
| 284 | Val_CAC_chr1:16136 9489-161369562 (-) | GTTTCCGTAGTGTAGTGGTTATCACGTTCGCC TCACACGCGAAAGGTCCCCGGTTCGAAACCG |
| 285 | Asp_GTC_chr1:16141 0614-161410686 (-) | TCCTCGTTAGTATAGTGGTGAGTATCCCCGCC TGTCACGCGGGAGACCGGGGTTCGATTCCCC |
| 286 | Gly_GCC_chr1:16141 3093-161413164 (+) | TGCATGGGTGGTTCAGTGGTAGAATTCTCGC CTGCCACGCGGGAGGCCCGGGTTCGATTCCC |
| 287 | Glu_CTC_chr1:16141 7017-161417089 (-) | TCCCTGGTGGTCTAGTGGTTAGGATTCGGCG CTCTCACCGCCGCGGCCCGGGTTCGATTCCC |
| 288 | Asp_GTC_chr1:16149 2934-161493006 (+) | ATCCTTGTTACTATAGTGGTGAGTATCTCTGC CTGTCATGCGTGAGAGAGGGGGTCGATTCCC |
| 289 | Gly_GCC_chr1:16149 3636-161493707 (-) | GCATTGGTGGTTCAGTGGTAGAATTCTCGCCT GCCACGCGGGAGGCCCGGGTTCGATTCCCGG |
| 290 | Leu_CAG_chr1:16150 0131-161500214 (-) | GTCAGGATGGCCGAGCGGTCTAAGGCGCTGC GTTCAGGTCGCAGTCTCCCCTGGAGGCGTGG |

TABLE 1-continued

| List of tRNA Sequences | | |
|---|---|---|
| SEQ ID NO | tRNA name | tRNA sequence |
| 291 | Gly_TCC_chr1:16150 0902-161500974 (+) | CGCGTTGGTGGTATAGTGGTGAGCATAGCTG CCTTCCAAGCAGTTGACCCGGGTTCGATTCCC |
| 292 | Asn_GTT_chr1:16151 0030-161510104 (+) | CGTCTCTGTGGCGCAATCGGTTAGCGCGTTC GGCTGTTAACCGAAAGGTTGGTGGTTCGATC |
| 293 | Glu_TTC_chr1:16158 2507-161582579 (+) | CGCGTTGGTGGTGTAGTGGTGAGCACAGCTG CCTTTCAAGCAGTTAACGCGGGTTCGATTCCC |
| 294 | Pro_CGG_chr1:16768 3961-167684033 (+) | CGGCTCGTTGGTCTAGGGGTATGATTCTCGCT TCGGGTGCGAGAGGTCCCGGGTTCAAATCCC |
| 295 | Pro_AGG_chr1:16768 4724-167684796 (-) | GGCTCGTTGGTCTAGGGGTATGATTCTCGCTT AGGGTGCGAGAGGTCCCGGGTTCAAATCCCG |
| 296 | Lys_TTT_chr1:20447 5654-204475727 (+) | CGCCCGGATAGCTCAGTCGGTAGAGCATCAG ACTTTTAATCTGAGGGTCCAGGGTTCAAGTC |
| 297 | Lys_TTT_chr1:20447 6157-204476230 (-) | GCCCGGATAGCTCAGTCGGTAGAGCATCAGA CTTTTAATCTGAGGGTCCAGGGTTCAAGTCCC |
| 298 | Leu_CAA_chr1:24916 8053-249168159 (+) | TGTCAGGATGGCCGAGTGGTCTAAGGCGCCA GACTCAAGGTAAGCACCTTGCCTGCGGGCTT |
| 299 | Glu_CTC_chr1:24916 8446-249168518 (+) | TTCCCTGGTGGTCTAGTGGTTAGGATTCGGCG CTCTCACCGCCGCGGCCCGGGTTCGATTCCC |
| 300 | Tyr_GTA_chr2:27273 649-27273738 (+) | GCCTTCGATAGCTCAGTTGGTAGAGCGGAGG ACTGTAGTGGATAGGGCGTGGCAATCCTTAG |
| 301 | Ala_AGC_chr2:27274 081-27274154 (+) | CGGGGGATTAGCTCAAATGGTAGAGCGCTCG CTTAGCATGCGAGAGGTAGCGGGATCGATGC |
| 302 | Ile_TAT_chr2:430376 75-43037768 (+) | AGCTCCAGTGGCGCAATCGGTTAGCGCGCGG TACTTATACAGCAGTACATGCAGAGCAATGC |
| 303 | Gly_CCC_chr2:70476 122-70476193 (-) | GCGCCGCTGGTGTAGTGGTATCATGCAAGAT TCCCATTCTTGCGACCCGGGTTCGATTCCCGG |
| 304 | Glu_TTC_chr2:13109 4700-131094772 (-) | TCCCATATGGTCTAGCGGTTAGGATTCCTGGT TTTCACCCAGGTGGCCCGGGTTCGACTCCCG |
| 305 | Ala_CGC_chr2:15725 7280-157257352 (+) | GGGGGATGTAGCTCAGTGGTAGAGCGCGCGC TTCGCATGTGTGAGGTCCCGGGTTCAATCCCC |
| 306 | Gly_GCC_chr2:15725 7658-157257729 (-) | GCATTGGTGGTTCAGTGGTAGAATTCTCGCCT GCCACGCGGGAGGCCCGGGTTCGATTCCCGG |
| 307 | Arg_ACG_chr3:45730 490-45730563 (-) | GGGCCAGTGGCGCAATGGATAACGCGTCTGA CTACGGATCAGAAGATTCTAGGTTCGACTCC |
| 308 | Val_AAC_chr3:16949 0017-169490090 (+) | GGTTTCCGTAGTGTAGTGGTTATCACGTTCGC CTAACACGCGAAAGGTCCCCGGTTCGAAACC |
| 309 | Val_AAC_chr5:18059 6609-180596682 (+) | AGTTTCCGTAGTGTAGTGGTTATCACGTTCGC CTAACACGCGAAAGGTCCCCGGTTCGAAACC |
| 310 | Leu_AAG_chr5:1806 14700-180614782 (+) | AGGTAGCGTGGCCGAGCGGTCTAAGGCGCTG GATTAAGGCTCCAGTCTCTTCGGGGGCGTGG |
| 311 | Val_AAC_chr5:18061 5415-180615488 (-) | GTTTCCGTAGTGTAGTGGTCATCACGTTCGCC TAACACGCGAAAGGTCCCCGGTTCGAAACCG |
| 312 | Pro_TGG_chr5:18061 5853-180615925 (-) | GGCTCGTTGGTCTAGGGGTATGATTCTCGCTT TGGGTGCGAGAGGTCCCGGGTTCAAATCCCG |
| 313 | Thr_TGT_chr5:18061 8686-180618758 (-) | GGCTCCATAGCTCAGGGGTTAGAGCACTGGT CTTGTAAACCAGGGTCGCGAGTTCAAATCTC |
| 314 | Ala_TGC_chr5:18063 3867-180633939 (+) | TGGGGATGTAGCTCAGTGGTAGAGCGCATGC TTTGCATGTATGAGGCCCCGGGTTCGATCCCC |

TABLE 1-continued

| | List of tRNA Sequences | |
|---|---|---|
| SEQ ID NO | tRNA name | tRNA sequence |
| 315 | Lys_CTT_chr5:18063 4754-180634827 (+) | CGCCCGGCTAGCTCAGTCGGTAGAGCATGAG ACTCTTAATCTCAGGGTCGTGGGTTCGAGCC |
| 316 | Val_AAC_chr5:18064 5269-180645342 (-) | GTTTCCGTAGTGTAGTGGTTATCACGTTCGCC TAACACGCGAAAGGTCCCCGGTTCGAAACCG |
| 317 | Lys_CTT_chr5:18064 8978-180649051 (-) | GCCCGGCTAGCTCAGTCGGTAGAGCATGAGA CTCTTAATCTCAGGGTCGTGGGTTCGAGCCCC |
| 318 | Val_CAC_chr5:18064 9394-180649467 (-) | GTTTCCGTAGTGTAGTGGTTATCACGTTCGCC TCACACGCGAAAGGTCCCCGGTTCGAAACCG |
| 319 | Met_CAT_chr6:26286 753-26286825 (+) | CAGCAGAGTGGCGCAGCGGAAGCGTGCTGG GCCCATAACCCAGAGGTCGATGGATCGAAAC |
| 320 | Ser_GCT_chr6:26305 717-26305801 (-) | GGAGAGGCCTGGCCGAGTGGTTAAGGCGATG GACTGCTAATCCATTGTGCTCTGCACGCGTG |
| 321 | Gln_TTG_chr6:26311 423-26311495 (-) | GGCCCCATGGTGTAATGGTTAGCACTCTGGA CTTTGAATCCAGCGATCCGAGTTCAAATCTC |
| 322 | Gln_TTG_chr6:26311 974-26312046 (-) | GGCCCCATGGTGTAATGGTTAGCACTCTGGA CTTTGAATCCAGCGATCCGAGTTCAAATCTC |
| 323 | Ser_TGA_chr6:26312 823-26312905 (-) | GTAGTCGTGGCCGAGTGGTTAAGGCGATGGA CTTGAAATCCATTGGGGTCTCCCCGCGCAGG |
| 324 | Met_CAT_chr6:26313 351-26313423 (-) | AGCAGAGTGGCGCAGCGGAAGCGTGCTGGG CCCATAACCCAGAGGTCGATGGATCGAAACC |
| 325 | Arg_TCG_chr6:26323 045-26323118 (+) | GGACCACGTGGCCTAATGGATAAGGCGTCTG ACTTCGGATCAGAAGATTGAGGGTTCGAATC |
| 326 | Ser_AGA_chr6:26327 816-26327898 (+) | TGTAGTCGTGGCCGAGTGGTTAAGGCGATGG ACTAGAAATCCATTGGGGTCTCCCCGCGCAG |
| 327 | Met_CAT_chr6:26330 528-26330600 (-) | AGCAGAGTGGCGCAGCGGAAGCGTGCTGGG CCCATAACCCAGAGGTCGATGGATCGAAACC |
| 328 | Leu_CAG_chr6:26521 435-26521518 (+) | CGTCAGGATGGCCGAGCGGTCTAAGGCGCTG CGTTCAGGTCGCAGTCTCCCCTGGAGGCGTG |
| 329 | Thr_AGT_chr6:26533 144-26533218 (-) | GGCTCCGTGGCTTAGCTGGTTAAAGCGCCTG TCTAGTAAACAGGAGATCCTGGGTTCGAATC |
| 330 | Arg_ACG_chr6:26537 725-26537798 (+) | AGGGCCAGTGGCGCAATGGATAACGCGTCTG ACTACGGATCAGAAGATTCCAGGTTCGACTC |
| 331 | Val_CAC_chr6:26538 281-26538354 (+) | GGTTTCCGTAGTGTAGTGGTTATCACGTTCGC CTCACACGCGAAAGGTCCCCGGTTCGAAACC |
| 332 | Ala_CGC_chr6:26553 730-26553802 (+) | AGGGGATGTAGCTCAGTGGTAGAGCGCATGC TTCGCATGTATGAGGTCCCGGGTTCGATCCCC |
| 333 | Ile_AAT_chr6:265543 49-26554423 (+) | TGGCCGGTTAGCTCAGTTGGTTAGAGCGTGG TGCTAATAACGCCAAGGTCGCGGGTTCGATC |
| 334 | Pro_AGG_chr6:26555 497-26555569 (+) | CGGCTCGTTGGTCTAGGGGTATGATTCTCGCT TAGGGTGCGAGAGGTCCCGGGTTCAAATCCC |
| 335 | Lys_CTT_chr6:26556 773-26556846 (+) | AGCCCGGCTAGCTCAGTCGGTAGAGCATGAG ACTCTTAATCTCAGGGTCGTGGGTTCGAGCC |
| 336 | Tyr_GTA_chr6:26569 085-26569176 (+) | TCCTTCGATAGCTCAGTTGGTAGAGCGGAGG ACTGTAGTTGGCTGTGTCCTTAGACATCCTTA |
| 337 | Ala_AGC_chr6:26572 091-26572164 (-) | GGGGAATTAGCTCAAATGGTAGAGCGCTCGC TTAGCATGCGAGAGGTAGCGGGATCGATGCC |
| 338 | Met_CAT_chr6:26766 443-26766516 (+) | CGCCCTCTTAGCGCAGCGGGCAGCGCGTCAG TCTCATAATCTGAAGGTCCTGAGTTCGAGCCT |

TABLE 1-continued

| List of tRNA Sequences | | |
| --- | --- | --- |
| SEQ ID NO | tRNA name | tRNA sequence |
| 339 | Ile_TAT_chr6:269881 24-26988218 (+) | TGCTCCAGTGGCGCAATCGGTTAGCGCGCGG TACTTATATGGCAGTATGTGTGCGAGTGATG |
| 340 | His_GTG_chr6:27125 905-27125977 (+) | TGCCGTGATCGTATAGTGGTTAGTACTCTGCG TTGTGGCCGCAGCAACCTCGGTTCGAATCCG |
| 341 | Ile_AAT_chr6:271449 93-27145067 (-) | GGCCGGTTAGCTCAGTTGGTTAGAGCGTGGT GCTAATAACGCCAAGGTCGCGGGTTCGATCC |
| 342 | Val_AAC_chr6:27203 287-27203360 (+) | AGTTTCCGTAGTGTAGTGGTTATCACGTTTGC CTAACACGCGAAAGGTCCCCGGTTCGAAACC |
| 343 | Val_CAC_chr6:27248 048-27248121 (-) | GCTTCTGTAGTGTAGTGGTTATCACGTTCGCC TCACACGCGAAAGGTCCCCGGTTCGAAACCG |
| 344 | Asp_GTC_chr6:27447 452-27447524 (+) | TTCCTCGTTAGTATAGTGGTGAGTATCCCCGC CTGTCACGCGGGAGACCGGGGTTCGATTCCC |
| 345 | Ser_TGA_chr6:27473 606-27473688 (-) | GTAGTCGTGGCCGAGTGGTTAAGGCGATGGA CTTGAAATCCATTGGGGTTTCCCCGCGCAGG |
| 346 | Gln_CTG_chr6:27487 307-27487379 (+) | AGGTTCCATGGTGTAATGGTTAGCACTCTGG ACTCTGAATCCAGCGATCCGAGTTCAAATCT |
| 347 | Asp_GTC_chr6:27551 235-27551307 (-) | TCCTCGTTAGTATAGTGGTGAGTGTCCCCGTC TGTCACGCGGGAGACCGGGGTTCGATTCCCC |
| 348 | Val_AAC_chr6:27618 706-27618779 (-) | GTTTCCGTAGTGTAGTGGTTATCACGTTCGCC TAACACGCGAAAGGTCCCTGGATCAAAACCA |
| 349 | Ile_AAT_chr6:276559 66-27656040 (+) | CGGCCGGTTAGCTCAGTTGGTTAGAGCGTGG TGCTAATAACGCCAAGGTCGCGGGTTCGATC |
| 350 | Gln_CTG_chr6:27759 134-27759206 (-) | GGCCCCATGGTGTAATGGTCAGCACTCTGGA CTCTGAATCCAGCGATCCGAGTTCAAATCTC |
| 351 | Gln_TTG_chr6:27763 639-27763711 (-) | GGCCCCATGGTGTAATGGTTAGCACTCTGGA CTTTGAATCCAGCGATCCGAGTTCAAATCTC |
| 352 | Ala_AGC_chr6:28574 932-28575004 (+) | TGGGGGTGTAGCTCAGTGGTAGAGCGCGTGC TTAGCATGTACGAGGTCCCGGGTTCAATCCC |
| 353 | Ala_AGC_chr6:28626 013-28626085 (-) | GGGGATGTAGCTCAGTGGTAGAGCGCATGCT TAGCATGCATGAGGTCCCGGGTTCGATCCCC |
| 354 | Ala_CGC_chr6:28697 091-28697163 (+) | AGGGGGTGTAGCTCAGTGGTAGAGCGCGTGC TTCGCATGTACGAGGCCCCGGGTTCGACCCC |
| 355 | Ala_AGC_chr6:28806 220-28806292 (-) | GGGGGTGTAGCTCAGTGGTAGAGCGCGTGCT TAGCATGCACGAGGCCCCGGGTTCAATCCCC |
| 356 | Ala_AGC_chr6:28831 461-28831533 (-) | GGGGGTGTAGCTCAGTGGTAGAGCGCGTGCT TAGCATGCACGAGGCCCCGGGTTCAATCCCC |
| 357 | Leu_CAA_chr6:28863 999-28864105 (-) | GTCAGGATGGCCGAGTGGTCTAAGGCGCCAG ACTCAAGCTAAGCTTCCTCCGCGGTGGGGAT |
| 358 | Leu_CAA_chr6:28908 829-28908934 (+) | TGTCAGGATGGCCGAGTGGTCTAAGGCGCCA GACTCAAGCTTGGCTTCCTCGTGTTGAGGATT |
| 359 | Gln_CTG_chr6:28909 377-28909449 (-) | GGTTCCATGGTGTAATGGTTAGCACTCTGGA CTCTGAATCCAGCGATCCGAGTTCAAATCTC |
| 360 | Leu_AAG_chr6:2891 1398-28911480 (-) | GGTAGCGTGGCCGAGCGGTCTAAGGCGCTGG ATTAAGGCTCCAGTCTCTTCGGGGGCGTGGG |
| 361 | Met_CAT_chr6:28912 351-28912424 (+) | TGCCTCCTTAGCGCAGTAGGCAGCGCGTCAG TCTCATAATCTGAAGGTCCTGAGTTCGAACCT |
| 362 | Lys_TTT_chr6:28918 805-28918878 (+) | AGCCCGGATAGCTCAGTCGGTAGAGCATCAG ACTTTTAATCTGAGGGTCCAGGGTTCAAGTC |

TABLE 1-continued

| List of tRNA Sequences | | |
| --- | --- | --- |
| SEQ ID NO | tRNA name | tRNA sequence |
| 363 | Met_CAT_chr6:28921<br>041-28921114 (-) | GCCTCCTTAGCGCAGTAGGCAGCGCGTCAGT<br>CTCATAATCTGAAGGTCCTGAGTTCGAACCT |
| 364 | Glu_CTC_chr6:28949<br>975-28950047 (+) | TTCCCTGGTGGTCTAGTGGTTAGGATTCGGCG<br>CTCTCACCGCCGCGGCCCGGGTTCGATTCCC |
| 365 | Leu_TAA_chr6:14453<br>7683-144537766 (+) | CACCAGGATGGCCGAGTGGTTAAGGCGTTGG<br>ACTTAAGATCCAATGGACATATGTCCGCGTG |
| 366 | Pro_AGG_chr7:12842<br>3503-128423575 (+) | TGGCTCGTTGGTCTAGGGGTATGATTCTCGCT<br>TAGGGTGCGAGAGGTCCCGGGTTCAAATCCC |
| 367 | Arg_CCT_chr7:13902<br>5445-139025518 (+) | AGCCCCAGTGGCCTAATGGATAAGGCATTGG<br>CCTCCTAAGCCAGGGATTGTGGGTTCGAGTC |
| 368 | Cys_GCA_chr7:14938<br>8271-149388343 (-) | GGGGATATAGCTCAGGGGTAGAGCATTTGAC<br>TGCAGATCAAGAGGTCCCCGGTTCAAATCCG |
| 369 | Tyr_GTA_chr8:67025<br>601-67025694 (+) | CCCTTCGATAGCTCAGCTGGTAGAGCGGAGG<br>ACTGTAGCTACTTCCTCAGCAGGAGACATCC |
| 370 | Tyr_GTA_chr8:67026<br>222-67026311 (+) | CCCTTCGATAGCTCAGCTGGTAGAGCGGAGG<br>ACTGTAGGCGCGCGCCCGTGGCCATCCTTAG |
| 371 | Ala_AGC_chr8:67026<br>423-67026496 (+) | TGGGGGATTAGCTCAAATGGTAGAGCGCTCG<br>CTTAGCATGCGAGAGGTAGCGGGATCGATGC |
| 372 | Ser_AGA_chr8:96281<br>884-96281966 (-) | GTAGTCGTGGCCGAGTGGTTAAGGCGATGGA<br>CTAGAAATCCATTGGGGTCTCCCCGCGCAGG |
| 373 | Met_CAT_chr8:12416<br>9469-124169542 (-) | GCCTCGTTAGCGCAGTAGGTAGCGCGTCAGT<br>CTCATAATCTGAAGGTCGTGAGTTCGATCCTC |
| 374 | Arg_TCT_chr9:13110<br>2354-131102445 (-) | GGCTCTGTGGCGCAATGGATAGCGCATTGGA<br>CTTCTAGCTGAGCCTAGTGTGGTCATTCAAA |
| 375 | Asn_GTT_chr10:2251<br>8437-22518511 (-) | GTCTCTGTGGCGCAATCGGTTAGCGCGTTCG<br>GCTGTTAACCGAAAGGTTGGTGGTTCGAGCC |
| 376 | Ser_TGA_chr10:6952<br>4260-69524342 (+) | GGCAGCGATGGCCGAGTGGTTAAGGCGTTGG<br>ACTTGAAATCCAATGGGGTCTCCCCGCGCAG |
| 377 | Val_TAC_chr11:5931<br>8101-59318174 (-) | GGTTCCATAGTGTAGTGGTTATCACGTCTGCT<br>TTACACGCAGAAGGTCCTGGGTTCGAGCCCC |
| 378 | Val_TAC_chr11:5931<br>8459-59318532 (-) | GGTTCCATAGTGTAGCGGTTATCACGTCTGCT<br>TTACACGCAGAAGGTCCTGGGTTCGAGCCCC |
| 379 | Arg_TCT_chr11:5931<br>8766-59318852 (+) | TGGCTCTGTGGCGCAATGGATAGCGCATTGG<br>ACTTCTAGATAGTTAGAGAAATTCAAAGGTT |
| 380 | Leu_TAA_chr11:5931<br>9227-59319310 (+) | TACCAGAATGGCCGAGTGGTTAAGGCGTTGG<br>ACTTAAGATCCAATGGATTCATATCCGCGTG |
| 381 | Lys_TTT_chr11:5932<br>3901-59323974 (+) | GGCCCGGATAGCTCAGTCGGTAGAGCATCAG<br>ACTTTTAATCTGAGGGTCCGGGGTTCAAGTC |
| 382 | Phe_GAA_chr11:5932<br>4969-59325042 (-) | GCCGAAATAGCTCAGTTGGGAGAGCGTTAGA<br>CTGAAGATCTAAAGGTCCCTGGTTCGATCCC |
| 383 | Lys_TTT_chr11:5932<br>7807-59327880 (-) | GCCCGGATAGCTCAGTCGGTAGAGCATCAGA<br>CTTTTAATCTGAGGGTCCAGGGTTCAAGTCCC |
| 384 | Phe_GAA_chr11:5933<br>3852-59333925 (-) | GCCGAAATAGCTCAGTTGGGAGAGCGTTAGA<br>CTGAAGATCTAAAGGTCCCTGGTTCAATCCC |
| 385 | Ser_GCT_chr11:6611<br>5590-66115672 (+) | GGACGAGGTGGCCGAGTGGTTAAGGCGATG<br>GACTGCTAATCCATTGTGCTTTGCACGCGTGG |
| 386 | Pro_TGG_chr11:7594<br>6868-75946940 (-) | GGCTCGTTGGTCTAGGGGTATGATTCTCGGTT<br>TGGGTCCGAGAGGTCCCGGGTTCAAATCCCG |

TABLE 1-continued

| List of tRNA Sequences | | |
|---|---|---|
| SEQ ID NO | tRNA name | tRNA sequence |
| 387 | Ser_CGA_chr12:5658 4147-56584229 (+) | AGTCACGGTGGCCGAGTGGTTAAGGCGTTGG ACTCGAAATCCAATGGGGTTTCCCCGCACAG |
| 388 | Asp_GTC_chr12:9889 7280-98897352 (+) | CTCCTCGTTAGTATAGTGGTTAGTATCCCCGC CTGTCACGCGGGAGACCGGGGTTCAATTCCC |
| 389 | Trp_CCA_chr12:9889 8029-98898101 (+) | GGACCTCGTGGCGCAACGGTAGCGCGTCTGA CTCCAGATCAGAAGGCTGCGTGTTCGAATCA |
| 390 | Ala_TGC_chr12:1254 06300-125406372 (-) | GGGGATGTAGCTCAGTGGTAGAGCGCATGCT TTGCATGTATGAGGCCCCGGGTTCGATCCCC |
| 391 | Phe_GAA_chr12:1254 12388-125412461 (-) | GCCGAAATAGCTCAGTTGGGAGAGCGTTAGA CTGAAGATCTAAAGGTCCCTGGTTCGATCCC |
| 392 | Ala_TGC_chr12:1254 24511-125424583 (+) | AGGGGATGTAGCTCAGTGGTAGAGCGCATGC TTTGCACGTATGAGGCCCCGGGTTCAATCCC |
| 393 | Asn_GTT_chr13:3124 8100-31248174 (-) | GTCTCTGTGGCGCAATCGGTTAGCGCGTTCG GCTGTTAACCGAAAGGTTGGTGGTTCGAGCC |
| 394 | Glu_TTC_chr13:4549 2061-45492133 (-) | TCCCACATGGTCTAGCGGTTAGGATTCCTGGT TTTCACCCAGGCGGCCCGGGTTCGACTCCCG |
| 395 | Thr_TGT_chr14:2108 1948-21082021 (-) | GGCTCCATAGCTCAGGGGTTAGAGCGCTGGT CTTGTAAACCAGGGGTCGCGAGTTCAATTCT |
| 396 | Leu_TAG_chr14:2109 3528-21093610 (+) | TGGTAGTGTGGCCGAGCGGTCTAAGGCGCTG GATTTAGGCTCCAGTCTCTTCGGGGGCGTGG |
| 397 | Thr_TGT_chr14:2109 9318-21099391 (-) | GGCTCCATAGCTCAGGGGTTAGAGCACTGGT CTTGTAAACCAGGGGTCGCGAGTTCAAATCT |
| 398 | Pro_TGG_chr14:2110 1164-21101236 (+) | TGGCTCGTTGGTCTAGTGGTATGATTCTCGCT TTGGGTGCGAGAGGTCCCGGGTTCAAATCCC |
| 399 | Tyr_GTA_chr14:2113 1350-21131444 (-) | CCTTCGATAGCTCAGCTGGTAGAGCGGAGGA CTGTAGATTGTACAGACATTTGCGGACATCC |
| 400 | Thr_TGT_chr14:2114 9848-21149921 (+) | AGGCCCTATAGCTCAGGGGTTAGAGCACTGG TCTTGTAAACCAGGGGTCGCGAGTTCAAATC |
| 401 | Tyr_GTA_chr14:2115 1431-21151520 (+) | TCCTTCGATAGCTCAGCTGGTAGAGCGGAGG ACTGTAGTACTTAATGTGTGGTCATCCTTAGG |
| 402 | Pro_TGG_chr14:2115 2174-21152246 (+) | TGGCTCGTTGGTCTAGGGGTATGATTCTCGCT TTGGGTGCGAGAGGTCCCGGGTTCAAATCCC |
| 403 | Lys_CTT_chr14:5870 6612-58706685 (-) | GCCCGGCTAGCTCAGTCGGTAGAGCATGGGA CTCTTAATCCCAGGGTCGTGGGTTCGAGCCC |
| 404 | Ile_AAT_chr14:10278 3428-102783502 (+) | CGGCCGGTTAGCTCAGTTGGTTAGAGCGTGG TGCTAATAACGCCAAGGTCGCGGGTTCGATC |
| 405 | Glu_TTC_chr15:2632 7380-26327452 (-) | TCCCACATGGTCTAGCGGTTAGGATTCCTGGT TTTCACCCAGGCGGCCCGGGTTCGACTCCCG |
| 406 | Ser_GCT_chr15:4088 6022-40886104 (-) | GACGAGGTGGCCGAGTGGTTAAGGCGATGG ACTGCTAATCCATTGTGCTCTGCACGCGTGG |
| 407 | His_GTG_chr15:4549 0803-45490875 (-) | GCCGTGATCGTATAGTGGTTAGTACTCTGCGT TGTGGCCGCAGCAACCTCGGTTCGAATCCGA |
| 408 | His_GTG_chr15:4549 3348-45493420 (+) | CGCCGTGATCGTATAGTGGTTAGTACTCTGC GTTGTGGCCGCAGCAACCTCGGTTCGAATCC |
| 409 | Gln_CTG_chr15:6616 1399-66161471 (-) | GGTTCCATGGTGTAATGGTTAGCACTCTGGA CTCTGAATCCAGCGATCCGAGTTCAAATCTC |
| 410 | Lys_CTT_chr15:7915 2903-79152976 (+) | TGCCCGGCTAGCTCAGTCGGTAGAGCATGGG ACTCTTAATCCCAGGGTCGTGGGTTCGAGCC |

TABLE 1-continued

| List of tRNA Sequences | | |
| --- | --- | --- |
| SEQ ID NO | tRNA name | tRNA sequence |
| 411 | Arg_TCG_chr15:8987 8303-89878376 (+) | GGGCCGCGTGGCCTAATGGATAAGGCGTCTG ACTTCGGATCAGAAGATTGCAGGTTCGAGTC |
| 412 | Gly_CCC_chr16:6867 35-686806 (-) | GCGCCGCTGGTGTAGTGGTATCATGCAAGAT TCCCATTCTTGCGACCCGGGTTCGATTCCCGG |
| 413 | Arg_CCG_chr16:3200 674-3200747 (+) | GGGCCGCGTGGCCTAATGGATAAGGCGTCTG ATTCCGGATCAGAAGATTGAGGGTTCGAGTC |
| 414 | Arg_CCT_chr16:3202 900-3202973 (+) | CGCCCCGGTGGCCTAATGGATAAGGCATTGG CCTCCTAAGCCAGGGATTGTGGGTTCGAGTC |
| 415 | Lys_CTT_chr16:3207 405-3207478 (-) | GCCCGGCTAGCTCAGTCGGTAGAGCATGAGA CCCTTAATCTCAGGGTCGTGGGTTCGAGCCC |
| 416 | Thr_CGT_chr16:1437 9749-14379821 (+) | AGGCGCGGTGGCCAAGTGGTAAGGCGTCGGT CTCGTAAACCGAAGATCACGGGTTCGAACCC |
| 417 | Leu_TAG_chr16:2220 7031-22207113 (-) | GGTAGCGTGGCCGAGTGGTCTAAGGCGCTGG ATTTAGGCTCCAGTCATTTCGATGGCGTGGGT |
| 418 | Leu_AAG_chr16:223 08460-22308542 (+) | GGGTAGCGTGGCCGAGCGGTCTAAGGCGCTG GATTAAGGCTCCAGTCTCTTCGGGGGCGTGG |
| 419 | Leu_CAG_chr16:5733 3862-57333945 (+) | AGTCAGGATGGCCGAGCGGTCTAAGGCGCTG CGTTCAGGTCGCAGTCTCCCCTGGAGGCGTG |
| 420 | Leu_CAG_chr16:5733 4391-57334474 (-) | GTCAGGATGGCCGAGCGGTCTAAGGCGCTGC GTTCAGGTCGCAGTCTCCCCTGGAGGCGTGG |
| 421 | Met_CAT_chr16:8741 7627-87417700 (-) | GCCTCGTTAGCGCAGTAGGCAGCGCGTCAGT CTCATAATCTGAAGGTCGTGAGTTCGAGCCT |
| 422 | Leu_TAG_chr17:8023 631-8023713 (-) | GGTAGCGTGGCCGAGCGGTCTAAGGCGCTGG ATTTAGGCTCCAGTCTCTTCGGAGGCGTGGG |
| 423 | Arg_TCT_chr17:8024 242-8024330 (+) | TGGCTCTGTGGCGCAATGGATAGCGCATTGG ACTTCTAGTGACGAATAGAGCAATTCAAAGG |
| 424 | Gly_GCC_chr17:8029 063-8029134 (+) | CGCATTGGTGGTTCAGTGGTAGAATTCTCGC CTGCCACGCGGGAGGCCCGGGTTCGATTCCC |
| 425 | Ser_CGA_chr17:8042 198-8042280 (-) | GCTGTGATGGCCGAGTGGTTAAGGCGTTGGA CTCGAAATCCAATGGGGTCTCCCCGCGCAGG |
| 426 | Thr_AGT_chr17:8042 769-8042843 (-) | GGCGCCGTGGCTTAGCTGGTTAAAGCGCCTG TCTAGTAAACAGGAGATCCTGGGTTCGAATC |
| 427 | Trp_CCA_chr17:8089 675-8089747 (+) | CGACCTCGTGGCGCAACGGTAGCGCGTCTGA CTCCAGATCAGAAGGTTGCGTGTTCAAATCA |
| 428 | Ser_GCT_chr17:8090 183-8090265 (+) | AGACGAGGTGGCCGAGTGGTTAAGGCGATG GACTGCTAATCCATTGTGCTCTGCACGCGTG |
| 429 | Thr_AGT_chr17:8090 477-8090551 (+) | CGGCGCCGTGGCTTAGTTGGTTAAAGCGCCT GTCTAGTAAACAGGAGATCCTGGGTTCGAAT |
| 430 | Trp_CCA_chr17:8124 186-8124258 (-) | GGCCTCGTGGCGCAACGGTAGCGCGTCTGAC TCCAGATCAGAAGGTTGCGTGTTCAAATCAC |
| 431 | Gly_TCC_chr17:8124 865-8124937 (+) | AGCGTTGGTGGTATAGTGGTAAGCATAGCTG CCTTCCAAGCAGTTGACCCGGGTTCGATTCCC |
| 432 | Asp_GTC_chr17:8125 555-8125627 (-) | TCCTCGTTAGTATAGTGGTGAGTATCCCCGCC TGTCACGCGGGAGACCGGGGTTCGATTCCCC |
| 433 | Pro_CGG_chr17:8126 150-8126222 (-) | GGCTCGTTGGTCTAGGGGTATGATTCTCGCTT CGGGTGCGAGAGGTCCCGGGTTCAAATCCCG |
| 434 | Thr_AGT_chr17:8129 552-8129626 (-) | GGCGCCGTGGCTTAGTTGGTTAAAGCGCCTG TCTAGTAAACAGGAGATCCTGGGTTCGAATC |
| 435 | Ser_AGA_chr17:8129 927-8130009 (-) | GTAGTCGTGGCCGAGTGGTTAAGGCGATGGA CTAGAAATCCATTGGGGTCTCCCCGCGCAGG |

TABLE 1-continued

| List of tRNA Sequences | | |
| --- | --- | --- |
| SEQ ID NO | tRNA name | tRNA sequence |
| 436 | Trp_CCA_chr17:1941 1493-19411565 (+) | TGACCTCGTGGCGCAATGGTAGCGCGTCTGA CTCCAGATCAGAAGGTTGCGTGTTCAAGTCA |
| 437 | Thr_CGT_chr17:2987 7092-29877164 (+) | AGGCGCGGTGGCCAAGTGGTAAGGCGTCGGT CTCGTAAACCGAAGATCGCGGGTTCGAACCC |
| 438 | Cys_GCA_chr17:3702 3897-37023969 (+) | AGGGGGTATAGCTCAGTGGTAGAGCATTTGA CTGCAGATCAAGAGGTCCCCGGTTCAAATCC |
| 439 | Cys_GCA_chr17:3702 5544-37025616 (-) | GGGGGTATAGCTCAGTGGTAGAGCATTTGAC TGCAGATCAAGAGGTCCCTGGTTCAAATCCG |
| 440 | Cys_GCA_chr17:3730 9986-37310058 (-) | GGGGGTATAGCTCAGTGGTAGAGCATTTGAC TGCAGATCAAGAGGTCCCCGGTTCAAATCCG |
| 441 | Gln_TTG_chr17:4726 9889-47269961 (+) | AGGTCCCATGGTGTAATGGTTAGCACTCTGG ACTTTGAATCCAGCGATCCGAGTTCAAATCT |
| 442 | Arg_CCG_chr17:6601 6012-66016085 (-) | GACCCAGTGGCCTAATGGATAAGGCATCAGC CTCCGGAGCTGGGGATTGTGGGTTCGAGTCC |
| 443 | Arg_CCT_chr17:7303 0000-73030073 (+) | AGCCCCAGTGGCCTAATGGATAAGGCACTGG CCTCCTAAGCCAGGGATTGTGGGTTCGAGTC |
| 444 | Arg_CCT_chr17:7303 0525-73030598 (-) | GCCCCAGTGGCCTAATGGATAAGGCACTGGC CTCCTAAGCCAGGGATTGTGGGTTCGAGTCC |
| 445 | Arg_TCG_chr17:7303 1207-73031280 (+) | AGACCGCGTGGCCTAATGGATAAGGCGTCTG ACTTCGGATCAGAAGATTGAGGGTTCGAGTC |
| 446 | Asn_GTT_chr19:1383 561-1383635 (+) | CGTCTCTGTGGCGCAATCGGTTAGCGCGTTC GGCTGTTAACCGAAAGGTTGGTGGTTCGAGC |
| 447 | Gly_TCC_chr19:4724 081-4724153 (+) | GGCGTTGGTGGTATAGTGGTTAGCATAGCTG CCTTCCAAGCAGTTGACCCGGGTTCGATTCCC |
| 448 | Val_CAC_chr19:4724 646-4724719 (-) | GTTTCCGTAGTGTAGCGGTTATCACATTCGCC TCACACGCGAAAGGTCCCCGGTTCGATCCCG |
| 449 | Thr_AGT_chr19:3366 7962-33668036 (+) | TGGCGCCGTGGCTTAGTTGGTTAAAGCGCCT GTCTAGTAAACAGGAGATCCTGGGTTCGAAT |
| 450 | Ile_TAT_chr19:39902 807-39902900 (-) | GCTCCAGTGGCGCAATCGGTTAGCGCGCGGT ACTTATATGACAGTGCGAGCGGAGCAATGCC |
| 451 | Gly_GCC_chr21:1882 7106-18827177 (-) | GCATGGGTGGTTCAGTGGTAGAATTCTCGCC TGCCACGCGGGAGGCCCGGGTTCGATTCCCG |

Non-Naturally Occurring Modification

A TREM, a TREM core fragment or a TREM fragment described herein comprises a non-naturally occurring modification, e.g., a modification described in any one of Tables 5-9. A non-naturally occurring modification can be made according to methods known in the art. Exemplary methods of making non-naturally occurring modifications are provided in Examples 4-7.

In an embodiment, a non-naturally occurring modification is a modification that a cell, e.g., a human cell, does not make on an endogenous tRNA.

In an embodiment, a non-naturally occurring modification is a modification that a cell, e.g., a human cell, can make on an endogenous tRNA, but wherein such modification is in a location in which it does not occur on a native tRNA. In an embodiment, the non-naturally occurring modification is in a domain, linker or arm which does not have such modification in nature. In an embodiment, the non-naturally occurring modification is at a position within a domain, linker or arm, which does not have such modification in nature. In an embodiment, the non-naturally occurring modification is on a nucleotide which does not have such modification in nature. In an embodiment, the non-naturally occurring modification is on a nucleotide at a position within a domain, linker or arm, which does not have such modification in nature.

In an embodiment, a TREM, a TREM core fragment or a TREM fragment described herein comprises a non-naturally occurring modification provided in Table 5, or a combination thereof.

TABLE 5

| Exemplary non-naturally occurring modifications |
| --- |
| Modification |
| 7-deaza-adenosine |
| N1-methyl-adenosine |
| N6, N6 (dimethyl)adenine |
| N6-cis-hydroxy-isopentenyl-adenosine |
| thio-adenosine |
| 2-(amino)adenine |
| 2-(aminopropyl)adenine |
| 2-(methylthio) N6 (isopentenyl)adenine |
| 2-(alkyl)adenine |

TABLE 5-continued

Exemplary non-naturally occurring modifications

Modification 2-(aminoalkyl)adenine
2-(aminopropyl)adenine
2-(halo)adenine
2-(propyl)adenine
2'-azido-2'-deoxy-adenosine
2'-Deoxy-2'-alpha-aminoadenosine
2'-Deoxy-2'-alpha-azidoadenosine
6-(alkyl)adenine
6-(methyl)adenine
6-(alkyl)adenine
6-(methyl)adenine
7-(deaza)adenine
8-(alkenyl)adenine
8-(alkynyl)adenine
8-(amino)adenine
8-(thioalkyl)adenine
8-(alkenyl)adenine
8-(alkyl)adenine
8-(alkynyl)adenine
8-(amino)adenine
8-(halo)adenine
8-(hydroxyl)adenine
8-(thioalkyl)adenine
8-(thiol)adenine
8-azido-adenosine
azaadenine
deazaadenine
N6-(methyl)adenine
N6-(isopentyl)adenine
7-deaza-8-aza-adenosine
7-methyladenine
1-deazaadenosine
2'-Fluoro-N6-Bz-deoxyadenosine
2'-OMe-2-Amino-adenosine
2'O-methyl-N6-Bz-deoxyadenosine
2'-alpha-ethynyladenosine
2-aminoadenine
2-Aminoadenosine
2-Amino-adenosine
2'-alpha-Trifluoromethyladenosine
2-Azidoadenosine
2'-beta-Ethynyladenosine
2-Bromoadenosine
2'-beta-Trifluoromethyladenosine
2-Chloroadenosine
2'-Deoxy-2',2'-difluoroadenosine
2'-Deoxy-2'-alpha-mercaptoadenosine
2'-Deoxy-2'-alpha-thiomethoxyadenosine
2'-Deoxy-2'-beta-aminoadenosine
2'-Deoxy-2'-beta-azidoadenosine
2'-Deoxy-2'-beta-bromoadenosine
2'-Deoxy-2'-beta-chloroadenosine
2'-Deoxy-2'-beta-fluoroadenosine
2'-Deoxy-2'-beta-iodoadenosine
2'-Deoxy-2'-beta-mercaptoadenosine
2'-Deoxy-2'-beta-thiomethoxyadenosine
2-Fluoroadenosine
2-Iodoadenosine
2-Mercaptoadenosine
2-methoxy-adenine
2-methylthio-adenine
2-Trifluoromethyladenosine
3-Deaza-3-bromoadenosine
3-Deaza-3-chloroadenosine
3-Deaza-3-fluoroadenosine
3-Deaza-3-iodoadenosine
3-Deazaadenosine
4'-Azidoadenosine
4'-Carbocyclic adenosine
4'-Ethynyladenosine
5'-Homo-adenosine
8-Aza-adenosine
8-bromo-adenosine
8-Trifluoromethyladenosine
9-Deazaadenosine
2-aminopurine TABLE 5-continued Exemplary non-naturally occurring modifications Modification 7-deaza-2,6-diaminopurine
7-deaza-8-aza-2,6-diaminopurine
7-deaza-8-aza-2-aminopurine
2,6-diaminopurine
7-deaza-8-aza-adenine, 7-deaza-2-aminopurine
4-methylcytidine
5-aza-cytidine
Pseudo-iso-cytidine
pyrrolo-cytidine
alpha-thio-cytidine
2-(thio)cytosine
2'-Amino-2'-deoxy-cytosine
2'-Azido-2'-deoxy-cytosine
2'-Deoxy-2'-alpha-aminocytidine
2'-Deoxy-2'-alpha-azidocytidine
3 (deaza) 5 (aza)cytosine
3 (methyl)cytosine
3-(alkyl)cytosine
3-(deaza) 5 (aza)cytosine
3-(methyl)cytidine
4,2'-O-dimethylcytidine
5 (halo)cytosine
5 (methyl)cytosine
5 (propynyl)cytosine
5 (trifluoromethyl)cytosine
5-(alkyl)cytosine
5-(alkynyl)cytosine
5-(halo)cytosine
5-(propynyl)cytosine
5-(trifluoromethyl)cytosine
5-bromo-cytidine
5-iodo-cytidine
5-propynyl cytosine
6-(azo)cytosine
6-aza-cytidine
aza cytosine
deaza cytosine
N4 (acetyl)cytosine
1-methyl-1-deaza-pseudoisocytidine
1-methyl-pseudoisocytidine
2-methoxy-5-methyl-cytidine
2-methoxy-cytidine
2-thio-5-methyl-cytidine
4-methoxy-1-methyl-pseudoisocytidine
4-methoxy-pseudoisocytidine
4-thio-1-methyl-1-deaza-pseudoisocytidine
4-thio-1-methyl-pseudoisocytidine
4-thio-pseudoisocytidine
5-aza-zebularine
5-methyl-zebularine
pyrrolo-pseudoisocytidine
zebularine
(E)-5-(2-Bromo-vinyl)cytidine
2,2'-anhydro-cytidine
2'-Fluor-N4-Bz-cytidine
2'-Fluoro-N4-Acetyl-cytidine
2'-O-Methyl-N4-Acetyl-cytidine
2'-O-methyl-N4-Bz-cytidine
2'-a-Ethynylcytidine
2'-a-Trifluoromethylcytidine
2'-b-Ethynylcytidine
2'-b-Trifluoromethylcytidine
2'-Deoxy-2',2'-difluorocytidine
2'-Deoxy-2'-alpha-mercaptocytidine
2'-Deoxy-2'-alpha-thiomethoxycytidine
2'-Deoxy-2'-betab-aminocytidine
2'-Deoxy-2'-beta-azidocytidine
2'-Deoxy-2'-beta-bromocytidine
2'-Deoxy-2'-beta-chlorocytidine
2'-Deoxy-2'-beta-fluorocytidine
2'-Deoxy-2'-beta-iodocytidine
2'-Deoxy-2'-beta-mercaptocytidine
2'-Deoxy-2'-beta-thiomethoxycytidine
2'-O-Methyl-5-(1-propynyl)cytidine TP
3'-Ethynylcytidine
4'-Azidocytidine TABLE 5-continued Exemplary non-naturally occurring modifications Modification 4'-Carbocyclic cytidine
4'-Ethynylcytidine
5-(1-Propynyl)ara-cytidine
5-(2-Chloro-phenyl)-2-thiocytidine
5-(4-Amino-phenyl)-2-thiocytidine
5-Aminoallyl-cytosine
5-Cyanocytidine
5-Ethynylara-cytidine
5-Ethynylcytidine
5'-Homo-cytidine
5-Methoxycytidine
5-Trifluoromethyl-Cytidine
N4-Amino-cytidine
N4-Benzoyl-cytidine
pseudoisocytidine
6-thio-guanosine
7-deaza-guanosine
8-oxo-guanosine
Nl-methyl-guanosine
alpha-thio-guanosine
2-(propyl)guanine
2-(alky1)guanine
2'-Amino-2'-deoxy-guanosine
2'-Azido-2'-deoxy-guanosine
2'-Deoxy-2'-alpha-aminoguanosine
2'-Deoxy-2'-alpha-azidoguanosine
6-(methyl)guanine
6-(alky1)guanine
6-(methyl)guanine
6-methyl-guanosine
7-(alkyl)guanine
7-(deaza)guanine
7-(methyl)guanine
7-(alkyl)guanine
7-(deaza)guanine
7-(methyl)guanine
8-(alkyl)guanine
8-(alkynyl)guanine
8-(halo)guanine
8-(thioalkyl)guanine
8-(alkenyl)guanine
8-(alkyl)guanine
8-(alkynyl)guanine
8-(amino)guanine
8-(halo)guanine
8-(hydroxyl)guanine
8-(thioalkyl)guanine
8-(thiol)guanine
azaguanine
deaza guanine
N (methyl)guanine
N-(methyl)guanine
1-methyl-6-thio-guanosine
6-methoxy-guanosine
6-thio-7-deaza-8-aza-guanosine
6-thio-7-deaza-guanosine
6-thio-7-methyl-guanosine
7-deaza-8-aza-guanosine
7-methyl-8-oxo-guanosine
N2,N2-dimethyl-6-thio-guanosine
N2-methyl-6-thio-guanosine
1-Me-guanosine
2'Fluoro-N2-isobutyl-guanosine
2'O-methyl-N2-isobutyl-guanosine
2'-alpha-Ethynylguanosine
2'-alpha-Trifluoromethylguanosine
2'-beta-Ethynylguanosine
2'-beta-Trifluoromethylguanosine
2'-Deoxy-2',2'-difluoroguanosine
2'-Deoxy-2'-alpha-mercaptoguanosine
2'-Deoxy-2'-alpha-thiomethoxyguanosine
2'-Deoxy-2'-beta-aminoguanosine
2'-Deoxy-2'-beta-azidoguanosine
2'-Deoxy-2'-beta-bromoguanosine
2'-Deoxy-2'-beta-chloroguanosine
2'-Deoxy-2'-beta-fluoroguanosine TABLE 5-continued Exemplary non-naturally occurring modifications Modification 2'-Deoxy-2'-beta-iodoguanosine
2'-Deoxy-2'-beta-mercaptoguanosine
2'-Deoxy-2'-beta-thiomethoxyguanosine
4'-Azidoguanosine
4'-Carbocyclic guanosine
4'-Ethynylguanosine
5'-Homo-guanosine
8-bromo-guanosine
9-Deazaguanosine
N2-isobutyl-guanosine
7-methylinosine
allyamino-thymidine
aza thymidine
deaza thymidine
deoxy-thymidine
5-propynyl uracil
alpha-thio-uridine
1-(aminoalkylamino-carbonylethylenyl)-2(thio)-pseudouracil
1-(aminoalkylaminocarbonylethylenyl)-2,4-(dithio)pseudouracil
1-(aminoalkylaminocarbonylethylenyl)-4(thio)pseudouracil
1-(aminoalkylaminocarbonylethylenyl)-pseudouracil
1-(aminocarbonylethylenyl)-2(thio)-pseudouracil
1-(aminocarbonylethylenyl)-2,4-(dithio)pseudouracil
1-(aminocarbonylethylenyl)-4(thio)pseudouracil
1-(aminocarbonylethylenyl)-pseudouracil
1-substituted 2-(thio)-pseudouracil
1-substituted 2,4-(dithio)pseudouracil
1-substituted 4 (thio)pseudouracil
1-substituted pseudouracil
1-(aminoalkylamino-carbonylethylenyl)-2-(thio)-pseudouracil
1-Methyl-3-(3-amino-3-carboxypropyl)pseudouridine
1-Methyl-3-(3-amino-3-carboxyproovl)pseudo-Uradine
1-Methyl-pseudo-UTP
2 (thio)pseudouracil
2' deoxy uridine
2' fluorouridine
2-(thio)uracil
2,4-(dithio)psuedouracil
2'-methyl, 2'-amino, 2'azido, 2'fluro-guanosine
2'-Amino-2'-deoxy-uridine
2'-Azido-2'-deoxy-uridine
2'-Azido-deoxyuridine
2'-O-methylpseudouridine
2' deoxyuridine
2' fluorouridine
2'-Deoxy-2'-alpha-aminouridine TP
2'-Deoxy-2'-alpha-azidouridine TP
2-methylpseudouridine
3-(3 amino-3-carboxypropyl)uracil
4-(thio)pseudouracil
4-(thio)pseudouracil
4-(thio)uracil
4-thiouracil
5-(1,3-diazole-1-alkyl)uracil
5-(2-aminopropyl)uracil
5-(aminoalkyl)uracil
5-(dimethylaminoalkyl)uracil
5-(guanidiniumalkyl)uracil
5-(methoxycarbonylmethyl)-2-(thio)uracil
5-(methoxycarbonyl-methyl)uracil
5-(methyl)-2-(thio)uracil
5-(methyl)-2,4-(dithio)uracil
5 (methyl) 4 (thio)uracil
5 (methylaminomethyl)-2 (thio)uracil
5 (methylaminomethyl)-2,4 (dithio)uracil
5 (methylaminomethyl)-4 (thio)uracil
5 (propynyl)uracil
5 (trifluoromethyl)uracil
5-(2-aminopropyl)uracil
5-(alky1)-2-(thio)pseudouracil
5-(alkyl)-2,4 (dithio)pseudouracil
5-(alky1)-4 (thio)pseudouracil
5-(alkyl)pseudouracil
5-(alkyl)uracil
5-(alkynyl)uracil
5-(allylamino)uracil TABLE 5-continued Exemplary non-naturally occurring modifications Modification 5-(cyanoalkyl)uracil
5-(dialkylaminoalkyl)uracil
5-(dimethylaminoalkyl)uracil
5-(guanidiniumalkyl)uracil
5-(halo)uracil
5-(1,3-diazole-1-alkyl)uracil
5-(methoxy)uracil
5-(methoxycarbonylmethyl)-2-(thio)uracil
5-(methoxycarbonyl-methyl)uracil
5-(methyl) 2(thio)uracil
5-(methyl) 2,4 (dithio)uracil
5-(methyl) 4 (thio)uracil
5-(methyl)-2-(thio)pseudouracil
5-(methyl)-2,4 (dithio)pseudouracil
5-(methyl)-4 (thio)pseudouracil
5-(methyl)pseudouracil
5-(methylaminomethyl)-2 (thio)uracil
5-(methylaminomethyl)-2,4(dithio)uracil
5-(methylaminomethyl)-4-(thio)uracil
5-(propyny1)uracil
5-(trifluoromethyl)uracil
5-aminoallyl-uridine
5-bromo-uridine
5-iodo-uridine
5-uracil
6 (azo)uracil
6-(azo)uracil
6-aza-uridine
allyamino-uracil
aza uracil
deaza uracil
N3 (methyl)uracil
Pseudo-uridine-1-2-ethanoic acid
pseudouracil
4-Thio-pseudouridine
1-carboxymethyl-pseudouridine
1-methyl-1-deaza-pseudouridine
1-propynyl-uridine
1-taurinomethyl-1-methyl-uridine
1-taurinomethyl-4-thio-uridine
1-taurinomethyl-pseudouridine
2-methoxy-4-thio-pseudouridine
2-thio-1-methyl-1-deaza-pseudouridine
2-thio-1-methyl-pseudouridine
2-thio-5-aza-uridine
2-thio-dihydropseudouridine
2-thio-dihydrouridine
2-thio-pseudouridine
4-methoxy-2-thio-pseudouridine
4-methoxy-pseudouridine
4-thio-1-methyl-pseudouridine
4-thio-pseudouridine
5-aza-uridine
dihydropseudouridine
(±) 1-(2-Hydroxypropyl)pseudouridine
(2R)-1-(2-Hydroxypropyl)pseudouridine
(2S)-1-(2-Hydroxypropyl)pseudouridine
(E)-5-(2-Bromo-vinyl)ara-uridine
(E)-5-(2-Bromo-vinyl)uridine
(Z)-5-(2-Bromo-vinyl)ara-uridine
(Z)-5-(2-Bromo-vinyl)uridine
1-(2,2,2-Trifluoroethyl)-pseudouridine
1-(2,2,3,3,3-Pentafluoropropyl)pseudouridine
1-(2,2-Diethoxyethy 1)pseudouridine
1-(2,4,6-Trimethylbenzyl)pseudouridine
1-(2,4,6-Trimethyl-benzyl)pseudo-uridine
1-(2,4,6-Trimethyl-phenyl)pseudo-uridine
1-(2-Amino-2-carboxyethyl)pseudo-uridine
1-(2-Amino-ethyl)pseudouridine
1-(2-Hydroxyethyl)pseudouridine
1-(2-Methoxyethyl)pseudouridine
1-(3,4-Bis-trifluoromethoxvbenzvl)pseudouridine
1-(3,4-Dimethoxybenzyl)pseudouridine
1-(3-Amino-3-carboxypropyl)pseudo-uridine
1-(3-Amino-propyl)pseudouridine
1-(3-Cyclopropyl-prop-2-ynyl)pseudouridine TP TABLE 5-continued Exemplary non-naturally occurring modifications Modification 1-(4-Amino-4-carboxybutyl)pseudouridine
1-(4-Amino-benzyl)pseudouridine
1-(4-Amino-buty l)pseudouridine
1-(4-Amino-phenyl)pseudouridine
1-(4-Azidobenzyl)pseudouridine
1-(4-Bromobenzyl)pseudouridine
1-(4-Chlorobenzyl)pseudouridine
1-(4-Fluorobenzyl)pseudouridin
1-(4-Iodobenzyl)pseudouridine
1-(4-Methanesulfonvlbenzvl)pseudouridine
1-(4-Methoxybenzy l)pseudouridine
1-(4-Methoxy-benzyl)pseudouridine
1-(4-Methoxy-phenyl)pseudouridine
1-(4-Methylbenzyl)pseudouridine
1-(4-Methyl-benzyl)pseudouridine
1-(4-Nitrobenzyl)pseudouridine
1-(4-Nitro-benzy!)pseudouridine
1(4-Nitro-phenyl)pseudouridine
1-(4-Thiomethoxybenzyl)pseudouridine
1-(4-Trifluoromethoxybenzvl)pseudouridine
1-(4-Trifluoromethylbenzyl)pseudouridine
1-(5-Amino-pentyl)pseudouridine
1-(6-Amino-hexyl)pseudouridine
1,6-Dimethyl-pseudouridine
1-[3-(2-{2-[2-(2-Aminoethoxy)-ethoxy]-ethoxy}-ethoxy)-
propionyl]pseudouridine
1-{3-[2-(2-Aminoethoxy)-ethoxy]-propionvl} pseudouridine
1-Acetylpseudouridine
1-Alkyl-6-(1-propynyl)-pseudo-uridine
1-Alkyl-6-(2-propynyl)-pseudo-uridine
1-Alkyl-6-allyl-pseudo-uridine
1-Alkyl-6-ethynyl-pseudo-uridine
1-Alkyl-6-homoallyl-pseudo-uridine
1-Alkyl-6-vinyl-pseudo-uridine
1-Allylpseudouridine
1-Aminomethyl-pseudo-uridine
1-Benzoylpseudouridine
1-Benzyloxymethylpseudouridine
1-Benzyl-pseudo-uridine
1-Biotinyl-PEG2-pseudouridine
1-Biotinylpseudouridine
1-Butyl-pseudo-uridine
1-Cyanomethylpseudouridine
1-Cyclobutylmethyl-pseudo-uridine
1-Cyclobutyl-pseudo-uridine
1-Cycloheptylmethyl-pseudo-uridine
1-Cycloheptyl-pseudo-uridine
1-Cyclohexylmethyl-pseudo-uridine
1-Cyclohexyl-pseudo-uridine
1-Cyclooctylmethyl-pseudo-uridine
1-Cyclooctyl-pseudo-uridine
1-Cyclopentylmethyl-pseudo-uridine
1-Cyclopentyl-pseudo-uridine
1-Cyclopropylmethyl-pseudo-uridine
1-Cyclopropyl-pseudo-uridine
1-Ethyl-pseudo-uridine
1-Hexyl-pseudo-uridine
1-Homoallylpseudouridine
1-Hydroxymethylpseudouridine
1-iso-propyl-pseudo-uridine
1-Me-2-thio-pseudo-uridine
1-Me-4-thio-pseudo-uridine
1-Me-alpha-thio-pseudo-uridine
1-Methanesulfonylmethylpseudouridine
1-Methoxymethylpseudouridine uridine
1-Methyl-6-(2,2,2-Trifluoroethyl)pseudo-uridine
1-Methyl-6-(4-morpholino)-pseudo-uridine
1-Methyl-6-(4-thiomorpholino)-pseudo-uridine
1-Methyl-6-(substituted phenyl)pseudo-uridine
1-Methyl-6-amino-pseudo-uridine
1-Methyl-6-azido-pseudo-uridine
1-Methyl-6-bromo-pseudo-uridine
1-Methyl-6-butyl-pseudo-uridine
1-Methyl-6-chloro-pseudo-uridine
1-Methyl-6-cyano-pseudo-uridine
1-Methyl-6-dimethylamino-pseudo-uridine TABLE 5-continued Exemplary non-naturally occurring modifications Modification 1-Methyl-6-ethoxy-pseudo-uridine
1-Methyl-6-ethylcarboxylate-pseudo-uridine
1-Methyl-6-ethyl-pseudo-uridine
1-Methyl-6-fluoro-pseudo-uridine
1-Methyl-6-formyl-pseudo-uridine
1-Methyl-6-hydroxyamino-pseudo-uridine
1-Methyl-6-hydroxy-pseudo-uridine
1-Methyl-6-iodo-pseudo-uridine
1-Methyl-6-iso-propyl-pseudo-uridine
1-Methyl-6-methoxy-pseudo-uridine
1-Methyl-6-methylamino-pseudo-uridine
1-Methyl-6-phenyl-pseudo-uridine
1-Methyl-6-propyl-pseudo-uridine
1-Methyl-6-tert-butyl-pseudo-uridine
1-Methyl-6-trifluoromethoxy-pseudo-uridine
1-Methyl-6-trifluoromethyl-pseudo-uridine
1-Morpholinomethylpseudouridine
1-Pentyl-pseudo-uridineuridine
1-Phenyl-pseudo-uridine
1-Pivaloylpseudouridine
1-Propargylpseudouridine
1-Propyl-pseudo-uridine
1-propynyl-pseudouridine
1-p-tolyl-pseudo-uridine
1-tert-Butyl-pseudo-uridine
1-Thiomethoxymethylpseudouridine
1-Thiomorpholinomethylpseudouridine
1-Trifluoroacetylpseudouridine
1-Trifluoromethyl-pseudouridine
1-Vinylpseudouridine
2,2'-anhydro-uridine
2'-bromo-deoxyuridine
2'-F-5-Methyl-2'-deoxy-uridine
2'-OMe-5-Me-uridine
2'-OMe-pseudouridine
2'-alpha-Ethynyluridine
2'-alpha-Trifluoromethyluridine
2'-beta-Ethynyluridine
2'-beta-Trifluoromethyluridiner
2'-Deoxy-2',2'-difluorouridine
2'-Deoxy-2'-a-mercaptouridin
2'-Deoxy-2'-alpha-thiomethoxyuridine
2'-Deoxy-2'-beta-aminouridine
2'-Deoxy-2'-beta-azidouridine
2'-Deoxy-2'-beta-bromouridine
2'-Deoxy-2'-beta-chlorouridine
2'-Deoxy-2'-beta-fluorouridine
2'-Deoxy-2'-beta-iodouridine
2'-Deoxy-2'-beta-mercaptouridine
2'-Deoxy-2'-beta-thiomethoxyuridine
2-methoxy-4-thio-uridine
2-methoxyuridine
2'-O-Methyl-5-(1-propynyl)uridine
3-Alkyl-pseudo-uridine
4'-Azidouridine
4'-Carbocyclic uridine
4'-Ethynyluridine
5-(1-Propynyl)ara-uridine
5-(2-Furanyl)uridine
5-Cyanouridine
5-Dimethylaminouridine
5'-Homo-uridine
5-iodo-2'-fluoro-deoxyuridine
5-Phenylethynyluridine
5-Trideuteromethyl-6-deuterouridine
5-Trifluoromethyl-Uridine
5-Vinylarauridine
6-(2,2,2-Trifluoroethyl)-pseudo-uridine
6-(4-Morpholino)-pseudo-uridine
6-(4-Thiomorpholino)-pseudo-uridine
6-(Substituted-Phenyl)-pseudo-uridine
6-Amino-pseudo-uridine
6-Azido-pseudo-uridine
6-Bromo-pseudo-uridine
6-Butyl-pseudo-uridine
6-Chloro-pseudo-uridine TABLE 5-continued Exemplary non-naturally occurring modifications Modification 6-Cyano-pseudo-uridine
6-Dimethylamino-pseudo-uridine
6-Ethoxy-pseudo-uridine
6-Ethylcarboxylate-pseudo-uridine
6-Ethyl-pseudo-uridine
6-Fluoro-pseudo-uridine
6-Formyl-pseudo-uridine
6-Hydroxyamino-pseudo-uridine
6-Hydroxy-pseudo-uridine
6-Iodo-pseudo-uridine
6-iso-Propyl-pseudo-uridine
6-Methoxy-pseudo-uridine
6-Methylamino-pseudo-uridine
6-Methyl-pseudo-uridine
6-Phenyl-pseudo-uridine
6-Phenyl-pseudo-uridine
6-Propyl-pseudo-uridine
6-tert-Butyl-pseudo-uridine
6-Trifluoromethoxy-pseudo-uridine
6-Trifluoromethyl-pseudo-uridine
alpha-thio-pseudo-uridine
Pseudouridine 1-(4-methylbenzenesulfonic acid)
Pseudouridine 1-(4-methylbenzoic acid) TP
Pseudouridine 1-[3-(2-ethoxy)]propionic acid
Pseudouridine 1-[3-{2-(2-[2-(2-ethoxy)-ethoxy]-ethoxy)-
ethoxy}]propionic acid
Pseudouridine 1-[3-{2-(2-[2-{2(2-ethoxy)-ethoxy}-ethoxy]-
ethoxy)-ethoxy}]propionic acid
Pseudouridine 1-[3-{2-(2-[2-ethoxy]-ethoxy)-ethoxv}]propionic acid
Pseudouridine 1-[3-{2-(2-ethoxy)-ethoxy}] propionic acid
Pseudouridine 1-methylphosphonic acid
Pseudouridine TP 1-methylphosphonic acid diethyl ester
Pseudo-uridine-N1-3-propionic acid
Pseudo-uridine-N1-4-butanoic acid
Pseudo-uridine-N 1-5-pentanoic acid
Pseudo-uridine-N1-6-hexanoic acid
Pseudo-uridine-N1-7-heptanoic acid
Pseudo-uridine-N1-methyl-p-benzoic acid
Pseudo-uridine-N1-p-benzoic acid In an embodiment, a TREM, a TREM core fragment or a TREM fragment described herein comprises a modification provided in Table 6, or a combination thereof. The modifications provided in Table 6 occur naturally in RNAs, and are used herein on a synthetic TREM, a TREM core fragment or a TREM fragment at a position that does not occur in nature.

TABLE 6

Additional exemplary modifications

Modification 2-methylthio-N6-(cis-hydroxvisopentenvl)adenosine
2-methylthio-N6-methyladenosine
2-methylthio-N6-threonyl carbamoyladenosine
N6-glycinylcarbamoyladenosine
N6-isopentenyladenosine
N6-methyladenosine
N6-threonylcarbamoyladenosine
1,2'-O-dimethyladenosine
1-methyladenosine
2'-O-methyladenosine
2'-O-ribosyladenosine (phosphate)
2-methyladenosine
2-methylthio-N6 isopentenyladenosine
2-methylthio-N6-hydroxynorvalyl carbamoyladenosine
2'-O-methyladenosine
2'-O-ribosyladenosine (phosphate)
isopenteny ladenosine
N6-(cis-hydroxyisopentenyl)adenosine
N6,2'-O-dimethyladenosine
N6,2'-O-dimethyladenosine TABLE 6-continued Additional exemplary modifications Modification N6,N6,2'-O-trimethyladenosine
N6,N6-dimethyladenosine
N6-acetyladenosine
N6-hydroxynorvalylcarbamoyladenosine
N6-methyl-N6-threonylcarbamoyladenosine
2-methyladenosine
2-methylthio-$N^6$-isopentenyladenosine
2-thiocytidine
3-methylcytidine
5-formylcytidine
5-hydroxymethylcytidine
5-methylcytidine
N4-acetylcytidine
2'-O-methylcytidine
2'-O-methylcytidine
5,2'-O-dimethylcytidine
5-formyl-2'-O-methylcytidine
lysidine
N4,2'-O-dimethy lcytidine
N4-acetyl-2'-O-methylcytidine
N4-methylcytidine
N4,N4-Dimethyl-2'-OMe-Cytidine
7-methylguanosine
N2,2'-O-dimethylguanosine
N2-methylguanosine
wyosme
1,2'-O-dimethylguanosine
1-methylguanosine
2'-O-methylguanosine
2'-O-ribosylguanosine (phosphate)
2'-O-methylguanosine
2'-O-ribosylguanosine (phosphate)
7-aminomethyl-7-deazaguanosine
7-cyano-7-deazaguanosine
archaeosine
methylwyosine
N2,7-dimethylguanosine
N2,N2,2'-O-trimethylguanosine
N2,N2,7-trimethylguanosine
N2,N2-dimethylguanosine
N2, 7,2'-O-trimethylguanosine
1-methylinosine
mosme
1,2'-O-dimethylinosine
2'-O-methylinosine
2'-O-methylinosine
epoxyqueuosine
galactosyl-queuosine
mannosyl-queuosine
2'-O-methyluridine
2-thiouridine
3-methyluridine
5-carboxymethyluridine
5-hydroxyuridine
5-methyluridine
5-taurinomethyl-2-thiouridine
5-taurinomethyluridine
dihydrouridine
pseudouridine
(3-(3-amino-3-carboxypropyl)uridine
1-methyl-3-(3-amino-5-carboxypropyl)pseudouridine
1-methylpseduouridine
1-methyl-pseudouridine
2'-O-methyluridine
2'-O-methylpseudouridine
2'-O-methyluridine
2-thio-2'-O-methyluridine
3-(3-amino-3-carboxypropyl)uridine
3,2'-0-dimethyluridine
3-Methyl-pseudo-Uridine
4-thiouridine
5-(carboxyhydroxymethyl)uridine
5-(carboxyhydroxymethyl)uridine methyl ester
5,2'-O-dimethyluridine
5,6-dihydro-uridine
5-aminomethy 1-2-thiouridine TABLE 6-continued Additional exemplary modifications Modification 5-carbamoylmethyl-2'-0-methyluridine
5-carbamoylmethyluridine
5-carboxyhydroxymethyluridine
5-carboxyhydroxymethyluridine methyl ester
5-carboxymethylaminomethyl-2'-O-methyluridine
5-carboxymethylaminomethyl-2-thiouridine
5-carboxymethylaminomethyl-2-thiouridine
5-carboxymethylaminomethyluridine
5-carboxymethylaminomethyluridine
5-Carbamoylmethyluridine
5-methoxycarbonylmethyl-2'-O-methyluridine
5-methoxycarbonylmethy 1-2-thiouridine
5-methoxycarbonylmethyluridine
5-methoxyuridine
5-methyl-2-thiouridine
5-methylaminomethyl-2-selenouridine
5-methylaminomethyl-2-thiouridine
5-methylaminomethyluridine
5-Methyldihydrouridine
5-Oxyacetic acid-Uridine
5-Oxyacetic acid-methyl ester-Uridin Nl-methyl-pseudo-uridine
uridine 5-oxyacetic acid
uridine 5-oxyacetic acid methyl ester
3-(3-Amino-3-carboxypropyl)-Uridine
5-(iso-Pentenylaminomethyl)-2-thiouridine
5-(iso-Pentenylaminomethyl)-2 '-O-methyluridine
5-(iso-Pentenylaminomethyl)uridine
wybutosine
hydroxywybutosine
isowyosme
peroxywybutosine
undermodified hydroxywybutosine
4-demethylwyosine
altriol In an embodiment, a TREM, a TREM core fragment or a TREM fragment described herein comprises a non-naturally occurring modification provided in Table 7, or a combination thereof.

TABLE 7

Additional exemplary non-naturally occurring modifications

Modification 2,6-(diamino)purine
1-(aza)-2-(thio)-3-(aza)-phenoxazin-1-yl
1,3-(diaza)-2-(oxo)-phenthiazin-1-yl
1,3-(diaza)-2-(oxo)-phenoxazin-1-yl
1,3,5-(triaza)-2,6-(dioxa)-naphthalene
2 (amino)purine
2,4,5-(trimethyl)phenyl
2' methyl, 2'amino, 2'azido, 2'fluro-cytidine
2' methyl, 2'amino, 2'azido, 2'fluro-adenine
2'methyl, 2'amino, 2'azido, 2'fluro-uridine
2'-amino-2'-deoxyribose
2-amino-6-Chloro-purine
2-aza-inosinyl
2'fluoro-2 '-deoxyribose
2'-azido-2'-deoxyribose
2'-fluoro-modified bases
2'-O-methyl-ribose
2-oxo-7-aminopyridopyrimidin-3-yl
2-oxo-pyridopyrimidine-3-yl
2-pyridinone
3 nitropyrrole
3-(methyl)-7-(propynyl)isocarbostyrilyl
3-(methyl)isocarbostyrilyl
4-(fluoro)-6-(methyl)benzimidazole
4-(methyl)benzimidazole
4-(methyl)indolyl
4,6-(dimethyl)indolyl
5 nitroindole TABLE 7-continued Additional exemplary non-naturally occurring modifications Modification 5 substituted pyrimidines
5-(methyl)isocarbostyrilyl
5-nitroindole
6-(aza)pyrimidine
6-(azo)thymine
6-(methyl)-7-(aza)indolyl
6-chloro-purine
6-phenyl-pyrrolo-pyrimidin-2-on-3-yl
7-(aminoalkylhydroxy)-1-(aza)-2-(thio)-3-(aza)-phenthiazin-1-yl
7-(aminoalkylhydroxy)-1-(aza)-2-(thio)-3-(aza)-phenoxazin-1-yl
7-(aminoalkylhydroxy)-1,3-(diaza)-2-(oxo)-phenoxazin-1-yl
7-(aminoalkylhydroxy)-1,3-(diaza)-2-(oxo)-phenthiazin-1-yl
7-(aminoalkylhydroxy)-1,3-(diaza)-2-(oxo)-phenoxazin-1-yl
7-(aza)indolyl
7-(guanidiniumalkylhydroxy)-1-(aza)-2-(thio)-3-(aza)-phenoxazinl-yl
7-(guanidiniumalkylhydroxy)-1-(aza)-2-(thio)-3-(aza)-phenthiazin-1-yl
7-(guanidiniumalkylhydroxy)-1,3-(thio)-3-(aza)-phenoxazin-1-yl
7-(guanidiniumalkylhydroxy)-1-(aza)-2-(diaza)-2-(oxo)-phenoxazin-1-yl
7-(guanidiniumalkyl-hydroxy)-1,3-(diaza)-2-(oxo)-phenthiazin-1-yl
7-(guanidiniumalkylhydroxy)-1,3-(diaza)-2-(oxo)-phenoxazin-1-yl
7-(propynyl)isocarbostyrilyl
7-(propynyl)isocarbostyrilyl, propynyl-7-(aza)indolyl
7-deaza-inosinyl
7-substituted 1-(aza)-2-(thio)-3-(aza)-phenoxazin-1-yl
7-substituted 1,3-(diaza)-2-(oxo)-phenoxazin-1-yl
9-(methyl)-imidizopyridinyl
aminoindolyl
anthracenyl
bis-ortho-(aminoalkylhydroxy)-6-phenyl-pyrrolo-nvrimidin-2-on-3-yl
bis-ortho-substituted-6-phenyl-pyrrolo-pyrimidin-2-on-3-yl
difluorotolyl
hypoxanthine
imidizopyridinyl
inosinyl
isocarbostyrilyl
isoguanosine
N2-substituted purines
N6-methyl-2-amino-purine
N6-substituted purines
N-alkylated derivative
napthalenyl
nitrobenzimidazolyl
nitroimidazolyl
nitroindazolyl
nitropyrazolyl
nubularine
O6-substituted purines
O-alkylated derivative
ortho-(aminoalkylhydroxy)-6-phenyl-pyrrolo-pyrimidin-2-on-3-yl
ortho-substituted-6-phenyl-pyrrolo-pyrimidin-2-on-3-yl
Oxoformycin TP
para-(aminoalkylhydroxy)-6-phenyl-pyrrolo-pyrimidin-2-on-3-yl
para-substituted-6-phenyl-pyrrolo-pyrimidin-2-on-3-yl
pentacenyl
phenanthracenyl
phenyl
propynyl-7-(aza)indolyl
pyrenyl
pyridopyrimidin-3-yl
pyridopyrimidin-3-y1, 2-oxo-7-amino-
pyridopyrimidin-3-yl
pyrrolo-pyrimidin-2-on-3-yl
pyrrolopyrimidinyl
pyrrolopyrizinyl
stilbenzyl
substituted 1,2,4-triazoles
tetracenyl
tubercidine
xanthine
Xanthosine
2-thio-zebularine
5-aza-2-thio-zebularine
7-deaza-2-amino-purine
pyridin-4-one ribonucleoside
2-Amino-riboside
Formycin A TABLE 7-continued Additional exemplary non-naturally occurring modifications Modification Formycin B
Pyrrolosine
2'-OH-ara-adenosine
2'-OH-ara-cytidine
2'-OH-ara-uridine
2'-OH-ara-guanosine
5-(2-carbomethoxyvinyl)uridine
N6-(19-Amino-pentaoxanonadecyl)adenosine In an embodiment, a TREM, a TREM core fragment or a
TREM fragment described herein comprises a non-naturally
occurring modification provided in Table 8, or a combina-
tion thereof.

TABLE 8

Exemplary backbone modifications

Modification

3'-alkylene phosphonates
3'-amino phosphoramidate
alkene containing backbones
aminoalkylphosphoramidates
aminoalkylphosphotriesters
boranophosphates
—CH2—O—N(CH3)—CH2—
—CH2—N(CH3)—N(CH3)—CH2—
—CH2—NH—CH2—
chiral phosphonates
chiral phosphorothioates
formacetyl and thioformacetyl backbones
methylene (methylimino)
methylene formacetyl and thioformacetyl backbones
methyleneimino and methylenehydrazino backbones
morpholino linkages
—N(CH3)—CH2—CH2—
oligonucleosides with heteroatom intenucleoside linkage
phosphinates
phosphoramidates
phosphorodithioates
phosphorothioate intenucleoside linkages
phosphorothioates
phosphotriesters
PNA
siloxane backbones
sulfamate backbones
sulfide sulfoxide and sulfone backbones
sulfonate and sulfonamide backbones
thionophosphoramidates
thionoalkylphosphonates
thionoalkylphosphotriesters
methylphosphonates
phosphonoacetates
Phosphorothioate
Constrained nucleic acid (CNA)
2'-O-methyl
2'-O-methoxyethyl (MOE)
2' Fluoro
Locked nucleic acid (LNA)
(S)-constrained ethyl (cEt)
Fluoro hexitol nucleic acid (FHNA)
5'-phosphorothioate
Phosphorodiamidate Morpholino Oligomer (PMO)
Tricyclo-DNA (tcDNA)
(S) 5'-C-methyl
(E)-vinylphosphonate
Methyl phosphonate
(S) 5'-C-methyl with phosphate
(R) 5'-C-methyl with phosphate
DNA
(R) 5'-C-methyl
GNA (glycol nucleic acid)
alkyl phosphonates

TABLE 8-continued

Exemplary backbone modifications

Modification

Phosphorothioate
Constrained nucleic acid (CNA)
2'-O-methyl
2'-O-methoxyethyl (MOE)
2' Fluoro
Locked nucleic acid (LNA)
(S)-constrained ethyl (cEt)
Fluoro hexitol nucleic acid (FHNA)
5'-phosphorothioate
Phosphorodiamidate Morpholino Oligomer (PMO)
Tricyclo-DNA (tcDNA)
(S) 5'-C-methyl
(E)-vinylphosphonate
Methyl phosphonate
(S) 5'-C-methyl with phosphate
(R) 5'-C-methyl with phosphate
DNA
(R) 5'-C-methyl
GNA (glycol nucleic acid)
alkyl phosphonates In an embodiment, a TREM, a TREM core fragment or a TREM fragment described herein comprises a non-naturally occurring modification provided in Table 9, or a combination thereof.

TABLE 9

Exemplary non-naturally occurring backbone modificiations

Name of synthetic backbone modifications

Phosphorothioate
Constrained nucleic acid (CNA)
2'-O-methylation
2'-O-methoxyethylribose (MOE)
2' Fluoro
Locked nucleic acid (LNA)
(S)-constrained ethyl (cEt)
Fluoro hexitol nucleic acid (FHNA)
5'phosphorothioate
Phosphorodiamidate Morpholino Oligomer (PMO)
Tricyclo-DNA (tcDNA)
(5) 5'-C-methyl
(E)-vinylphosphonate
Methyl phosphonate
(S) 5'-C-methyl with phosphate

TREM, TREM Core Fragment and TREM Fragment Fusions

In an embodiment, a TREM, a TREM core fragment or a TREM fragment disclosed herein comprises an additional moiety, e.g., a fusion moiety. In an embodiment, the fusion moiety can be used for purification, to alter folding of the TREM, TREM core fragment or TREM fragment, or as a targeting moiety. In an embodiment, the fusion moiety can comprise a tag, a linker, can be cleavable or can include a binding site for an enzyme. In an embodiment, the fusion moiety can be disposed at the N terminal of the TREM or at the C terminal of the TREM, TREM core fragment or TREM fragment. In an embodiment, the fusion moiety can be encoded by the same or different nucleic acid molecule that encodes the TREM, TREM core fragment or TREM fragment.

TREM Consensus Sequence

In an embodiment, a TREM disclosed herein comprises a consensus sequence provided herein.

In an embodiment, a TREM disclosed herein comprises a consensus sequence of Formula I$_{ZZZ}$, wherein zzz indicates any of the twenty amino acids and Formula I corresponds to all species.

In an embodiment, a TREM disclosed herein comprises a consensus sequence of Formula II$_{ZZZ}$, wherein zzz indicates any of the twenty amino acids and Formula II corresponds to mammals.

In an embodiment, a TREM disclosed herein comprises a consensus sequence of Formula III zzz, wherein zzz indicates any of the twenty amino acids and Formula III corresponds to humans.

In an embodiment, zzz indicates any of the twenty amino acids: alanine, arginine, asparagine, aspartate, cysteine, glutamine, glutamate, glycine, histidine, isoleucine, methionine, leucine, lysine, phenylalanine, proline, serine, threonine, tryptophan, tyrosine, or valine.

In an embodiment, a TREM disclosed herein comprises a property selected from the following:
a) under physiological conditions residue $R_0$ forms a linker region, e.g., a Linker 1 region;
b) under physiological conditions residues $R_1$-$R_2$-$R_3$-$R_4$-$R_5$-$R_6$-$R_7$ and residues $R_{65}$-$R_{66}$-$R_{67}$-$R_{68}$-$R_{69}$-$R_{70}$-$R_{71}$ form a stem region, e.g., an AStD stem region;
c) under physiological conditions residues $R_8$-$R_9$ forms a linker region, e.g., a Linker 2 region;
d) under physiological conditions residues -$R_{10}$-$R_{11}$-$R_{12}$-$R_{13}$-$R_{14}$   $R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$ form a stem-loop region, e.g., a D arm Region;
e) under physiological conditions residue-$R_{29}$ forms a linker region, e.g., a Linker 3 Region;
f) under physiological conditions residues -$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$ form a stem-loop region, e.g., an AC arm region;
g) under physiological conditions residue-$[R_{47}]_x$ comprises a variable region, e.g., as described herein;
h) under physiological conditions residues -$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$ form a stem-loop region, e.g., a T arm Region; or
i) under physiological conditions residue $R_{72}$ forms a linker region, e.g., a Linker 4 region.

Alanine TREM Consensus Sequence

In an embodiment, a TREM disclosed herein comprises the sequence of Formula I$_{ALA}$ (SEQ ID NO: 562),
$R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$,
wherein R is a ribonucleotide residue and the consensus for Ala is: $R_0$=absent; $R_{14}$, $R_{57}$=are independently A or absent; $R_{26}$-A, C, G or absent; $R_5$, $R_6$, $R_{15}$, $R_{16}$, $R_{21}$, $R_{30}$, $R_{31}$, $R_{32}$, $R_{34}$, $R_{37}$, $R_{41}$, $R_{42}$, $R_{43}$, $R_{44}$, $R_{45}$, $R_{48}$, $R_{49}$, $R_{50}$, $R_{58}$, $R_{59}$, $R_{63}$, $R_{64}$, $R_{66}$, $R_{67}$=are independently N or absent; $R_{11}$, $R_{35}$, $R_{65}$=are independently A, C, U or absent; $R_1$, $R_9$, $R_{20}$, $R_{38}$, $R_{40}$, $R_{51}$, $R_{52}$, $R_{56}$=are independently A, G or absent; $R_7$, $R_{22}$, $R_{25}$, $R_{27}$, $R_{29}$, $R_{46}$, $R_{53}$, $R_{72}$=are independently A, G, U or absent; $R_{24}$, $R_{69}$=are independently A, U or absent; $R_0$, $R_7$=are independently C or absent; $R_3$, $R_4$=are independently C, G or absent; $R_{12}$, $R_{33}$, $R_{36}$, $R_{62}$, $R_{65}$=are independently C, G, U or absent; $R_{13}$, $R_{17}$, $R_{28}$, $R_{39}$, $R_{55}$, $R_{60}$, $R_{61}$=are independently C, U or absent; $R_{10}$, $R_{19}$, $R_{23}$=are independently G or absent; $R_2$=G, U or absent; $R_8$, $R_{18}$, $R_{54}$=are independently U or absent; $[R_{47}]_x$=N or absent; wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{ALA}$ (SEQ ID NO: 563), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ala is:

$R_0$, $R_{18}$=are absent;

$R_{14}$, $R_{24}$, $R_{57}$=are independently A or absent;

$R_{15}$, $R_{26}$, $R_{64}$=are independently A, C, G or absent;

$R_{16}$, $R_{31}$, $R_{50}$, $R_{59}$=are independently N or absent;

$R_{11}$, $R_{32}$, $R_{37}$, RAI, $R_{43}$, $R_{45}$, $R_{49}$, $R_{65}$, $R_{66}$=are independently A, C, U or absent;

$R_1$, $R_5$, $R_9$, $R_{25}$, $R_{27}$, $R_{38}$, $R_{40}$, $R_{46}$, $R_{51}$, $R_{56}$=are independently A, G or absent;

$R_7$, $R_{22}$, $R_{29}$, $R_{42}$, $R_{44}$, $R_{53}$, $R_{63}$, $R_{72}$=are independently A, G, U or absent;

$R_6$, $R_{35}$, $R_{69}$=are independently A, U or absent;

$R_{55}$, $R_{60}$, $R_{70}$, $R_{71}$=are independently C or absent;

$R_3$=C, G or absent;

$R_{12}$, $R_{36}$, $R_{48}$=are independently C, G, U or absent;

$R_{13}$, $R_{17}$, $R_{28}$, $R_{30}$, $R_{34}$, $R_{39}$, $R_{58}$, $R_{61}$, $R_{62}$, $R_{67}$, $R_{68}$=are independently C, U or absent;

$R_4$, $R_{10}$, $R_{19}$, $R_{20}$, $R_{23}$, $R_{52}$=are independently G or absent;

$R_2$, $R_8$, $R_{33}$=are independently G, U or absent;

$R_{21}$, $R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{ALA}$ (SEQ ID NO: 564), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ala is:

$R_0$, $R_{18}$=are absent;

$R_{14}$, $R_{24}$, $R_{57}$, $R_{72}$=are independently A or absent;

$R_{15}$, $R_{26}$, $R_{64}$=are independently A, C, G or absent;

$R_{16}$, $R_{31}$, $R_{50}$=are independently N or absent;

$R_{11}$, $R_{32}$, $R_{37}$, $R_{41}$, $R_{43}$, $R_{45}$, $R_{49}$, $R_{65}$, $R_{66}$=are independently A, C, U or absent;

$R_5$, $R_9$, $R_{25}$, $R_{27}$, $R_{38}$, $R_{40}$, $R_{46}$, $R_{51}$, $R_{56}$=are independently A, G or absent;

$R_7$, $R_{22}$, $R_{29}$, $R_{42}$, $R_{44}$, $R_{53}$, $R_{63}$=are independently A, G, U or absent;

$R_6$, $R_{35}$=are independently A, U or absent;

$R_{55}$, $R_{60}$; $R_{61}$, $R_{70}$, $R_{71}$=are independently C or absent;

$R_{12}$, $R_{48}$, $R_{59}$=are independently C, G, U or absent;

$R_{13}$, $R_{17}$, $R_{28}$, $R_{30}$, $R_{34}$, $R_{39}$, $R_{58}$, $R_{62}$, $R_{67}$, $R_{68}$=are independently C, U or absent; $R_1$, $R_2$, $R_3$, $R_4$, $R_{10}$, $R_{19}$, $R_{20}$, $R_{23}$, $R_{52}$=are independently G or absent;

$R_{33}$, $R_{36}$=are independently G, U or absent;

$R_8$, $R_{21}$, $R_{54}$, $R_{69}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Arginine TREM Consensus Sequence

In an embodiment, a TREM disclosed herein comprises the sequence of Formula $I_{ARG}$ (SEQ ID NO: 565), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Arg is:

$R_{57}$=A or absent;

$R_9$,$R_{27}$=are independently A,C,G or absent;

$R_1$,$R_2$,$R_3$,$R_4$,$R_5$,$R_6$,$R_7$,$R_{11}$,$R_{12}$,$R_{16}$,$R_{21}$,$R_{22}$,$R_{23}$,$R_{25}$,$R_{26}$, $R_{29}$,$R_{30}$,$R_{31}$,$R_{32}$,$R_{33}$,$R_{34}$,$R_{37}$,$R_{42}$,$R_{44}$,$R_{45}$, $R_{46}$, $R_{48}$, $R_{49}$,$R_{50}$,$R_{51}$,$R_{58}$,$R_{62}$,$R_{63}$,$R_{64}$,$R_{65}$,$R_{66}$,$R_{67}$,$R_{68}$,$R_{69}$, $R_{70}$,$R_{71}$=are independently N or absent;

$R_{13}$,$R_{17}$,$R_{41}$=are independently A,C,U or absent;

$R_{19}$,$R_{20}$,$R_{24}$,$R_{40}$,$R_{56}$=are independently A,G or absent;

$R_{14}$,$R_{15}$,$R_{72}$=are independently A,G,U or absent;

$R_{18}$=A,U or absent;

$R_{38}$=C or absent;

$R_{35},R_{43},R_{61}$=are independently C,G,U or absent;

$R_{28}, R_{55},R_{59},R_{60}$=are independently C,U or absent;

$R_0,R_{10},R_{52}$=are independently G or absent;

$R_8,R_{39}$=are independently G,U or absent;

$R_{36},R_{53},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{ARG}$ (SEQ ID NO: 566), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Arg is:

$R_{18}$=absent;

$R_{24},R_{57}$=are independently A or absent;

$R_{41}$=A,C or absent;

$R_3,R_7,R_{34},R_{50}$=are independently A,C,G or absent;

$R_2,R_5,R_6,R_{12},R_{26},R_{32},R_{37},R_{44},R_{58},R_{66},R_{67},R_{68},R_{70}$=are independently N or absent;

$R_{49},R_{71}$=are independently A,C,U or absent;

$R_1,R_{15},R_{19},R_{25},R_{27},R_{40},R_{45},R_{46},R_{56},R_{72}$=are independently A,G or absent;

$R_{14},R_{29}, R_{63}$=are independently A,G,U or absent;

$R_{16},R_{21}$=are independently A,U or absent;

$R_{38},R_{61}$=are independently C or absent;

$R_{33},R_{48}$=are independently C,G or absent;

$R_4,R_5,R_{11},R_{43},R_{62},R_{64},R_{69}$=are independently C,G,U or absent;

$R_{13},R_{22},R_{28},R_{30},R_{31},R_{35},R_{55},R_{60},R_{65}$=are independently C,U or absent;

$R_0,R_{10},R_{20},R_{23},R_{51},R_{52}$=are independently G or absent;

$R_8,R_{39},R_{42}$=are independently G,U or absent;

$R_{17},R_{36},R_{53}, R_{54},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{ARG}$ (SEQ ID NO: 567), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Arg is:

$R_{18}$=is absent;

$R_{15},R_{21},R_{24},R_{41},R_{57}$=are independently A or absent;

$R_{34},R_{44}$=are independently A,C or absent;

$R_3,R_5,R_{55}$=are independently A,C,G or absent;

$R_2,R_6,R_{66},R_{70}$=are independently N or absent;

$R_{37},R_{49}$=are independently A,C,U or absent;

$R_1,R_{25},R_{29},R_{40},R_{45},R_{46},R_{50}$=are independently A,G or absent;

$R_{14},R_{63},R_{68}$=are independently A,G,U or absent;

$R_{16}$=A,U or absent;

$R_{38}, R_{61}$=are independently C or absent;

$R_7,R_{11},R_{12},R_{26},R_{48}$=are independently C,G or absent;

$R_{64},R_{67},R_{69}$=are independently C,G,U or absent;

$R_4,R_{13},R_{22},R_{28},R_{30},R_{31},R_{35},R_{43},R_{55},R_{60},R_{62},R_{65}$, $R_{71}$=are independently C,U or absent;

$R_0,R_{10},R_{19}, R_{20},R_{23},R_{27},R_{33},R_{51},R_{52}, R_{56},R_{72}$=are independently G or absent;

$R_8,R_9,R_{32},R_{39},R_{42}$=are independently G,U or absent;

$R_{17},R_{36},R_{53},R_{54},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Asparagine TREM Consensus Sequence

In an embodiment, a TREM disclosed herein comprises the sequence of Formula $I_{ASN}$ (SEQ ID NO: 568), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asn is:

$R_0,R_{18}$=are absent;

$R_{41}$=A or absent;

$R_{14},R_{48},R_{56}$=are independently A,C,G or absent;

$R_2,R_4,R_5,R_6,R_{12},R_{17},R_{26},R_{29},R_{30},R_{31},R_{44},R_{45},R_{46},R_{49},$ $R_{50},R_{58},R_{62},R_{63},R_{65},R_{66},R_{67},R_{68},R_{70},R_{71}$=are independently N or absent;

$R_{11},R_{13},R_{22},R_{42},R_{55},R_{59}$=are independently A,C,U or absent;

$R_0,R_{15},R_{24},R_{27},R_{34},R_{37},R_{51},R_{72}$=are independently A,G or absent;

$R_1,R_7,R_{25},R_{69}$=are independently A,G,U or absent;

$R_{40},R_{57}$=are independently A,U or absent;

$R_{60}$=C or absent;

$R_{33}$=C,G or absent;

$R_{21},R_{32},R_{43},R_{64}$=are independently C,G,U or absent;

$R_3,R_{16},R_{28},R_{35},R_{36},R_{61}$=are independently C,U or absent;

$R_{10},R_{19},R_{20},R_{52}$=are independently G or absent;

$R_{54}$=G,U or absent;

$R_8,R_{23},R_{38},R_{39},R_{53}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{ASN}$ (SEQ ID NO: 569), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asn is:

$R_0,R_{18}$=are absent $R_{24},R_{41},R_{46},R_{62}$=are independently A or absent;

$R_{59}$=A,C or absent;

$R_{14},R_{56},R_{66}$=are independently A,C,G or absent;

$R_{17},R_{29}$=are independently N or absent;

$R_{11},R_{26},R_{42},R_{55}$=are independently A,C,U or absent;

$R_1,R_9,R_{12},$   $R_{15},R_{25},R_{34},R_{37},R_{48},R_{51},R_{67},R_{68},R_{69},R_{70},$ $R_{72}$=are independently A,G or absent;

$R_{44},R_{45},R_{58}$=are independently A,G,U or absent;

$R_{40},R_{57}$=are independently A,U or absent;

$R_5,R_{28},R_{60}$=are independently C or absent;

$R_{33},R_{65}$=are independently C,G or absent;

$R_{21},R_{43},R_{71}$=are independently C,G,U or absent;

$R_3,R_6,R_{13},R_{22},R_{32},R_{35},R_{36},R_{61},R_{63},R_{64}$=are independently C,U or absent;

$R_7,R_{10},R_{19},R_{20},R_{27},R_{49},R_{52}$=are independently G or absent;

$R_{54}$=G,U or absent;

$R_2,R_4,R_8,R_{16},R_{23},R_{30},R_{31},R_{38},R_{39},R_{50},R_{53}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{ASN}$ (SEQ ID NO: 570), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asn is:

$R_0,R_{18}$=are absent $R_{24},R_{40},R_{41},R_{46},R_{62}$=are independently A or absent;

$R_{59}$=A,C or absent;

$R_{14},R_{56},R_{66}$=are independently A,C,G or absent;

$R_{11},R_{26},R_{42},R_{55}$=are independently A,C,U or absent;

$R_1,R_9,R_{12},R_{15},R_{34},R_{37},R_{48},R_{51},R_{67},R_{68},R_{69},R_{70}$=are independently A,G or absent;

$R_{44},R_{45},R_{55}$=are independently A,G,U or absent;

$R_{57}$=A,U or absent;

$R_5,R_{28},R_{60}$=are independently C or absent;

$R_{33},R_{65}$=are independently C,G or absent;

$R_{17},R_{21},R_{29}$=are independently C,G,U or absent;

$R_3,R_6,R_{13},R_{22},R_{32},R_{35},R_{36},R_{43},R_{61},R_{63},R_{64},R_{71}$=are independently C,U or absent;

$R_7,R_{10},R_{19},R_{20},R_{25},R_{27},R_{49},R_{52},R_{72}$=are independently G or absent;

$R_{54}$=G,U or absent;

$R_2,R_4,R_8,R_{16},R_{23},R_{30},R_{31},R_{38},R_{39},R_{50},R_{53}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Aspartate TREM Consensus sequence

In an embodiment, a TREM disclosed herein comprises the sequence of Formula I$_{ASP}$ (SEQ ID NO: 571), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asp is:

$R_0$=absent $R_{24}$,$R_{71}$=are independently A,C or absent;

$R_{33}$,$R_{46}$=are independently A,C,G or absent;

$R_2$,$R_3$,$R_4$,$R_5$,$R_6$,$R_{12}$,$R_{16}$,$R_{22}$,$R_{26}$,$R_{29}$,$R_{31}$,$R_{32}$,$R_{44}$,$R_{48}$, $R_{49}$,$R_{55}$,$R_{63}$,$R_{64}$,$R_{66}$,$R_{67}$,$R_{68}$,$R_{69}$=are independently N or absent;

$R_{13}$,$R_{21}$,$R_{34}$,$R_{41}$,$R_{57}$,$R_{65}$=are independently A,C,U or absent;

$R_0$,$R_{10}$,$R_{14}$,$R_{15}$,$R_{20}$,$R_{27}$,$R_{37}$,$R_{40}$,$R_{51}$,$R_{56}$,$R_{72}$=are independently A,G or absent;

$R_7$,$R_{25}$,$R_{42}$=are independently A,G,U or absent;

$R_{39}$=C or absent;

$R_{50}$,$R_{62}$=are independently C,G or absent;

$R_{30}$,$R_{43}$,$R_{45}$,$R_{55}$,$R_{70}$=are independently C,G,U or absent;

$R_8$, $R_{11}$,$R_{17}$,$R_{18}$,$R_{28}$,$R_{35}$,$R_{53}$,$R_{59}$,$R_{60}$,$R_{61}$=are independently C,U or absent;

$R_{19}$,$R_{52}$=are independently G or absent;

$R_1$=G,U or absent;

$R_{23}$,$R_{36}$,$R_{38}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{ASP}$ (SEQ ID NO: 572), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asp is:

$R_0$,$R_{17}$,$R_{18}$,$R_{23}$=are independently absent;

$R_0$,$R_{40}$=are independently A or absent;

$R_{24}$,$R_{71}$=are independently A,C or absent;

$R_{67}$,$R_{68}$=are independently A,C,G or absent;

$R_2$,$R_6$,$R_{66}$=are independently N or absent;

$R_{57}$,$R_{63}$=are independently A,C,U or absent;

$R_{10}$,$R_{14}$,$R_{27}$,$R_{33}$,$R_{37}$,$R_{44}$,$R_{46}$,$R_{51}$,$R_{56}$,$R_{64}$,$R_{72}$=are independently A,G or absent;

$R_7$,$R_{12}$,$R_{26}$, $R_{65}$=are independently A,U or absent;

$R_{39}$,$R_{61}$,$R_{62}$=are independently C or absent;

$R_3$,$R_{31}$,$R_{45}$,$R_{70}$=are independently C,G or absent;

$R_4$,$R_5$,$R_{29}$,$R_{43}$,$R_{55}$=are independently C,G,U or absent;

$R_8$,$R_{11}$,$R_{13}$,$R_{30}$,$R_{32}$,$R_{34}$,$R_{35}$,$R_{41}$,$R_{48}$,$R_{53}$,$R_{59}$,$R_{60}$=are independently C,U or absent;

$R_{15}$,$R_{19}$,$R_{20}$,$R_{25}$,$R_{42}$,$R_{50}$,$R_{52}$=are independently G or absent;

$R_1$,$R_{22}$,$R_{49}$,$R_{58}$,$R_{69}$=are independently G,U or absent;

$R_{16}$,$R_{21}$,$R_{28}$,$R_{36}$,$R_{38}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{ASP}$ (SEQ ID NO: 573), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Asp is:

$R_0$,$R_{17}$,$R_{18}$, $R_{23}$=are absent $R_9$,$R_{12}$,$R_{40}$,$R_{65}$,$R_{71}$=are independently A or absent;

$R_2$,$R_{24}$,$R_{57}$=are independently A,C or absent;

$R_6$,$R_{14}$,$R_{27}$,$R_{46}$,$R_{51}$,$R_{56}$,$R_{64}$,$R_{67}$,$R_{68}$=are independently A,G or absent;

$R_3$,$R_{31}$,$R_{35}$,$R_{39}$,$R_{61}$,$R_{62}$=are independently C or absent;

$R_{66}$=C,G or absent;

$R_5$,$R_8$,$R_{29}$,$R_{30}$,$R_{32}$,$R_{34}$,$R_{41}$,$R_{43}$,$R_{48}$,$R_{55}$,$R_{59}$,$R_{60}$,$R_{63}$=are independently C,U or absent;

$R_{10}$,$R_{15}$,$R_{19}$,$R_{20}$,$R_{25}$,$R_{33}$,$R_{37}$,$R_{42}$,$R_{44}$,$R_{45}$,$R_{49}$,$R_{50}$,$R_{52}$, $R_{69}$,$R_{70}$,$R_{72}$=are independently G or absent;

$R_{22}$,$R_{58}$=are independently G,U or absent;

$R_1$,$R_4$,$R_7$,$R_{11}$,$R_{13}$,$R_{16}$,$R_{21}$,$R_{26}$,$R_{28}$,$R_{36}$,$R_{38}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5; x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Cysteine TREM Consensus Sequence

In an embodiment, a TREM disclosed herein comprises the sequence of Formula $I_{CYS}$ (SEQ ID NO: 574), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Cys is:

$R_0$=absent $R_{14}$,$R_{39}$,$R_{57}$=are independently A or absent;

$R_{41}$=A,C or absent;

$R_{10}$,$R_{15}$, $R_{27}$,$R_{33}$,$R_{62}$=are independently A,C,G or absent;

$R_3$,$R_4$,$R_5$,$R_6$,$R_{12}$,$R_{13}$,$R_{16}$,$R_{24}$,$R_{26}$,$R_{29}$,$R_{30}$,$R_{31}$,$R_{32}$,$R_{34}$, $R_{42}$,$R_{44}$,$R_{45}$,$R_{46}$,$R_{48}$,$R_{49}$,$R_{58}$,$R_{63}$,$R_{64}$,$R_{66}$, $R_{67}$,$R_{68}$, $R_{69}$,$R_{70}$=are independently N or absent;

$R_{65}$=A,C,U or absent;

$R_0$,$R_{25}$,$R_{37}$,$R_{40}$,$R_{52}$,$R_{56}$=are independently A,G or absent;

$R_7$,$R_{20}$,$R_{51}$=are independently A,G,U or absent;

$R_{18}$, $R_{38}$,$R_{55}$=are independently C or absent;

$R_2$=C, G or absent;

$R_{21}$,$R_{28}$,$R_{43}$,$R_{50}$=are independently C,G,U or absent;

$R_{11}$,$R_{22}$,$R_{23}$,$R_{35}$,$R_{36}$,$R_{59}$,$R_{60}$,$R_{61}$,$R_{71}$,$R_{72}$=are independently C,U or absent;

$R_1$,$R_{19}$=are independently G or absent;

$R_{17}$=G,U or absent;

$R_8$,$R_{53}$,$R_{54}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{CYS}$ (SEQ ID NO: 575), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Cys is:

$R_0$,$R_{18}$, $R_{23}$=are absent;

$R_{14}$,$R_{24}$,$R_{26}$,$R_{29}$,$R_{39}$,$R_{41}$,$R_{45}$,$R_{57}$=are independently A or absent;

$R_{44}$=A,C or absent;

$R_{27}$,$R_{62}$=are independently A,C,G or absent;

$R_{16}$=A,C,G,U or absent;

$R_{30}$,$R_{70}$=are independently A,C,U or absent;

$R_5$,$R_7$,$R_0$,$R_{25}$,$R_{34}$,$R_{37}$,$R_{40}$,$R_{46}$,$R_{52}$,$R_{56}$,$R_{58}$,$R_{66}$=are independently A,G or absent;

$R_{20}$,$R_{51}$=are independently A,G,U or absent;

$R_{35}$,$R_{38}$, $R_{43}$, $R_{55}$,$R_{69}$=are independently C or absent;

$R_2$,$R_4$,$R_{15}$=are independently C,G or absent;

$R_{13}$=C,G,U or absent;

$R_6$,$R_{11}$,$R_{28}$,$R_{36}$,$R_{48}$,$R_{49}$,$R_{50}$,$R_{60}$,$R_{61}$,$R_{67}$,$R_{68}$,$R_{71}$, $R_{72}$=are independently C,U or absent;

$R_1$,$R_3$,$R_{10}$,$R_{19}$,$R_{33}$,$R_{63}$=are independently G or absent;

$R_8$,$R_{17}$,$R_{21}$,$R_{64}$=are independently G,U or absent;

$R_{12}$,$R_{22}$,$R_{31}$,$R_{32}$,$R_{42}$,$R_{53}$,$R_{54}$,$R_{65}$=are independently U or absent;

$R_{59}$=U, or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{CYS}$ (SEQ ID NO: 576), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Cys is:

$R_0$,$R_{18}$, $R_{23}$=are absent $R_{14}$,$R_{24}$,$R_{26}$, $R_{29}$,$R_{34}$,$R_{39}$,$R_{41}$,$R_{45}$,$R_{57}$,$R_{58}$=are independently A or absent;

$R_{44}$,$R_{70}$=are independently A,C or absent;

$R_{62}$=A,C,G or absent;

$R_{16}$=N or absent;

$R_5$,$R_7$,$R_9$,$R_{20}$,$R_{40}$,$R_{46}$,$R_{51}$,$R_{52}$,$R_{56}$,$R_{66}$=are independently A,G or absent;

$R_{28}$,$R_{35}$,$R_{38}$,$R_{43}$,$R_{55}$,$R_{67}$,$R_{69}$=are independently C or absent;

$R_4$,$R_{15}$=are independently C,G or absent;

$R_6$,$R_{11}$,$R_{13}$,$R_{30}$,$R_{48}$,$R_{49}$,$R_{50}$,$R_{60}$,$R_{61}$,$R_{68}$,$R_{71}$,$R_{72}$=are independently C,U or absent;

$R_1$,$R_2$,$R_3$,$R_{10}$,$R_{19}$,$R_{25}$,$R_{27}$,$R_{33}$, $R_{37}$,$R_{63}$=are independently G or absent;

$R_8$,$R_{21}$,$R_{64}$=are independently G,U or absent;

$R_{12}$, $R_{17}$,$R_{22}$,$R_{31}$,$R_{32}$,$R_{36}$,$R_{42}$,$R_{53}$,$R_{54}$, $R_{59}$,$R_{65}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Glutamine TREM Consensus Sequence

In an embodiment, a TREM disclosed herein comprises the sequence of Formula $I_{GLN}$ (SEQ ID NO: 577), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Gln is:

$R_0$,$R_{18}$=are absent;

$R_{14}$,$R_{24}$,$R_{57}$=are independently A or absent;

$R_9$,$R_{26}$,$R_{27}$,$R_{33}$,$R_{56}$=are independently A,C,G or absent;

$R_2$,$R_4$,$R_5$,$R_6$,$R_{12}$,$R_{13}$,$R_{16}$,$R_{21}$,$R_{22}$,$R_{25}$,$R_{29}$,$R_{30}$,$R_{31}$,$R_{32}$, $R_{34}$,$R_{41}$,$R_{42}$,$R_{44}$,$R_{45}$,$R_{46}$,$R_{48}$,$R_{49}$,$R_{50}$,$R_{58}$,$R_{62}$, $R_{63}$, $R_{66}$,$R_{67}$,$R_{68}$,$R_{69}$,$R_{70}$=are independently N or absent;

$R_{17}$,$R_{23}$,$R_{43}$,$R_{65}$,$R_{71}$=are independently A,C,U or absent;

$R_{15}$,$R_{40}$,$R_{51}$,$R_{52}$=are independently A,G or absent;

$R_1$,$R_7$,$R_{72}$=are independently A,G,U or absent;

$R_3$,$R_{11}$,$R_{37}$,$R_{60}$,$R_{64}$=are independently C,G,U or absent;

$R_{28}$, $R_{35}$,$R_{55}$,$R_{59}$,$R_{61}$=are independently C,U or absent;

$R_{10}$,$R_{19}$,$R_{20}$=are independently G or absent;

$R_{39}$=G,U or absent;

$R_8$,$R_{36}$,$R_{38}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27; x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{GLN}$ (SEQ ID NO: 578), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Gln is:

$R_0$,$R_{18}$, $R_{23}$=are absent $R_{14}$,$R_{24}$,$R_{57}$=are independently A or absent;

$R_{17}$,$R_{71}$=are independently A,C or absent;

$R_{25}$, $R_{26}$,$R_{33}$,$R_{44}$,$R_{46}$,$R_{56}$,$R_{69}$=are independently A,C,G or absent;

$R_4$,$R_5$,$R_{12}$,$R_{22}$,$R_{29}$,$R_{30}$,$R_{48}$,$R_{49}$,$R_{63}$,$R_{67}$,$R_{68}$=are independently N or absent;

$R_{31}$,$R_{43}$,$R_{62}$,$R_{65}$,$R_{70}$=are independently A,C,U or absent;

$R_{15}$,$R_{27}$,$R_{34}$,$R_{40}$,$R_{41}$,$R_{51}$,$R_{52}$=are independently A,G or absent;

$R_2$,$R_7$,$R_{21}$,$R_{45}$,$R_{50}$,$R_{58}$,$R_{66}$,$R_{72}$=are independently A,G,U or absent;

$R_3$,$R_{13}$,$R_{32}$,$R_{37}$,$R_{42}$,$R_{60}$,$R_{64}$=are independently C,G,U or absent;

$R_6$,$R_{11}$,$R_{28}$,$R_{35}$,$R_{55}$,$R_{59}$,$R_{61}$=are independently C,U or absent;

$R_0$,$R_{10}$,$R_{19}$,$R_{20}$=are independently G or absent;

$R_1$,$R_{16}$,$R_{39}$=are independently G,U or absent;

$R_8$,$R_{36}$,$R_{38}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{GLN}$ (SEQ ID NO: 579), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Gln is:

$R_0$,$R_{18}$,$R_{23}$=are absent $R_{14}$,$R_{24}$,$R_{41}$,$R_{57}$=are independently A or absent;

$R_{17}$,$R_{71}$=are independently A,C or absent;

$R_5$,$R_{25}$,$R_{26}$,$R_{46}$,$R_{56}$,$R_{69}$=are independently A,C,G or absent;

$R_4$,$R_{22}$,$R_{29}$,$R_{30}$,$R_{48}$, $R_{49}$,$R_{63}$,$R_{68}$=are independently N or absent;

$R_{43}$,$R_{62}$,$R_{65}$,$R_{70}$=are independently A,C,U or absent;

$R_{15}$,$R_{27}$,$R_{33}$,$R_{34}$,$R_{40}$,$R_{51}$,$R_{52}$=are independently A,G or absent;

$R_2$,$R_7$,$R_{12}$,$R_{45}$,$R_{50}$,$R_{58}$,$R_{66}$=are independently A,G,U or absent;

$R_{31}$=A,U or absent;

$R_{32}$,$R_{44}$,$R_{60}$=are independently C,G or absent;

$R_3$,$R_{13}$,$R_{37}$,$R_{42}$,$R_{64}$,$R_{67}$=are independently C,G,U or absent;

$R_6$,$R_{11}$,$R_{28}$,$R_{35}$,$R_{55}$,$R_{59}$,$R_{61}$=are independently C,U or absent;

$R_0$,$R_{10}$,$R_{19}$,$R_{20}$=are independently G or absent;

$R_1$,$R_{21}$,$R_{39}$,$R_{72}$=are independently G,U or absent;

$R_8$,$R_{16}$,$R_{36}$,$R_{38}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-

25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Glutamate TREM Consensus Sequence

In an embodiment, a TREM disclosed herein comprises the sequence of Formula $I_{GLU}$ (SEQ ID NO: 580), $$R_0\text{-}R_1\text{-}R_2\text{-}R_3\text{-}R_4\text{-}R_5\text{-}R_6\text{-}R_7\text{-}R_8\text{-}R_9\text{-}R_{10}\text{-}R_{11}\text{-}R_{12}\text{-}R_{13}\text{-}R_{14}\text{-}$$
$$R_{15}\text{-}R_{16}\text{-}R_{17}\text{-}R_{18}\text{-}R_{19}\text{-}R_{20}\text{-}R_{21}\text{-}R_{22}\text{-}R_{23}\text{-}R_{24}\text{-}R_{25}\text{-}R_{26}\text{-}$$
$$R_{27}\text{-}R_{28}\text{-}R_{29}\text{-}R_{30}\text{-}R_{31}\text{-}R_{32}\text{-}R_{33}\text{-}R_{34}\text{-}R_{35}\text{-}R_{36}\text{-}R_{37}\text{-}R_{38}\text{-}$$
$$R_{39}\text{-}R_{40}\text{-}R_{41}\text{-}R_{42}\text{-}R_{43}\text{-}R_{44}\text{-}R_{45}\text{-}R_{46}\text{-}[R_{47}]_x\text{-}R_{48}\text{-}R_{49}\text{-}$$
$$R_{50}\text{-}R_{51}\text{-}R_{52}\text{-}R_{53}\text{-}R_{54}\text{-}R_{55}\text{-}R_{56}\text{-}R_{57}\text{-}R_{58}\text{-}R_{59}\text{-}R_{60}\text{-}R_{61}\text{-}$$
$$R_{62}\text{-}R_{63}\text{-}R_{64}\text{-}R_{65}\text{-}R_{66}\text{-}R_{67}\text{-}R_{68}\text{-}R_{69}\text{-}R_{70}\text{-}R_{71}\text{-}R_{72}$$

wherein R is a ribonucleotide residue and the consensus for Glu is:

$R_0$=absent;

$R_{34},R_{43}$, $R_{68},R_{69}$=are independently A,C,G or absent;

$R_1,R_2,R_5,R_6,R_0,R_{12},R_{16},R_{20},R_{21},R_{26},R_{27},R_{29},R_{30},R_{31}$, $R_{32},R_{33},R_{41},R_{44},R_{45},R_{46},R_{48},R_{50},R_{51},R_{58}$, $R_{63}$, $R_{64}$, $R_{65},R_{66},R_0,R_{71}$=are independently N or absent;

$R_{13}$, $R_{17},R_{23},R_{61}$=are independently A,C,U or absent;

$R_{10},R_{14},R_{24},R_{40},R_{52},R_{56}$=are independently A,G or absent;

$R_7,R_{15},R_{25},R_{67},R_{72}$=are independently A,G,U or absent;

$R_{11},R_{57}$=are independently A,U or absent;

$R_{39}$=C,G or absent;

$R_3,R_4,R_{22},R_{42},R_{49},R_{55},R_{62}$=are independently C,G,U or absent;

$R_{18}$, $R_{28},R_{35},R_{37},R_{53},R_{59},R_{60}$=are independently C,U or absent;

$R_{19}$=G or absent;

$R_8,R_{36},R_{38},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{GLU}$ (SEQ ID NO: 581), $$R_0\text{-}R_1\text{-}R_2\text{-}R_3\text{-}R_4\text{-}R_5\text{-}R_6\text{-}R_7\text{-}R_8\text{-}R_9\text{-}R_{10}\text{-}R_{11}\text{-}R_{12}\text{-}R_{13}\text{-}R_{14}\text{-}$$
$$R_{15}\text{-}R_{16}\text{-}R_{17}\text{-}R_{18}\text{-}R_{19}\text{-}R_{20}\text{-}R_{21}\text{-}R_{22}\text{-}R_{23}\text{-}R_{24}\text{-}R_{25}\text{-}R_{26}\text{-}$$
$$R_{27}\text{-}R_{28}\text{-}R_{29}\text{-}R_{30}\text{-}R_{31}\text{-}R_{32}\text{-}R_{33}\text{-}R_{34}\text{-}R_{35}\text{-}R_{36}\text{-}R_{37}\text{-}R_{38}\text{-}$$
$$R_{39}\text{-}R_{40}\text{-}R_{41}\text{-}R_{42}\text{-}R_{43}\text{-}R_{44}\text{-}R_{45}\text{-}R_{46}\text{-}[R_{47}]_x\text{-}R_{48}\text{-}R_{49}\text{-}$$
$$R_{50}\text{-}R_{51}\text{-}R_{52}\text{-}R_{53}\text{-}R_{54}\text{-}R_{55}\text{-}R_{56}\text{-}R_{57}\text{-}R_{58}\text{-}R_{59}\text{-}R_{60}\text{-}R_{61}\text{-}$$
$$R_{62}\text{-}R_{63}\text{-}R_{64}\text{-}R_{65}\text{-}R_{66}\text{-}R_{67}\text{-}R_{68}\text{-}R_{69}\text{-}R_{70}\text{-}R_{71}\text{-}R_{72}$$

wherein R is a ribonucleotide residue and the consensus for Glu is:

$R_0,R_{18}$, $R_{23}$=are absent $R_{17},R_{40}$=are independently $\lambda$ or absent;

$R_{26}$, $R_{27},R_{34},R_{43},R_{68},R_{69},R_{71}$=are independently A,C,G or absent;

$R_1,R_2,R_5,R_{12},R_{21},R_{31},R_{33},R_{41},R_{45},R_{48},R_{51},R_{58},R_{66}$, $R_{70}$=are independently N or absent;

$R_{44},R_{61}$=are independently A,C,U or absent;

$R_9,R_{14},R_{24},R_{25},R_{52},R_{56},R_{63}$=are independently A,G or absent;

$R_7,R_{15},R_{46},R_{50},R_{67},R_{72}$=are independently A,G,U or absent;

$R_{29},R_{57}$=are independently A,U or absent;

$R_{60}$=C or absent;

$R_{39}$=C,G or absent;

$R_3,R_6,R_{20},R_{30},R_{32},R_{42},R_{55},R_{62},R_{65}$=are independently C,G,U or absent;

$R_4,R_8,R_{16},R_{28},R_{35},R_{37},R_{49},R_{53},R_{59}$=are independently C,U or absent;

$R_{10},R_{19}$=are independently G or absent;

$R_{22},R_{64}$=are independently G,U or absent;

$R_{11},R_{13},R_{36},R_{38},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{GLU}$ (SEQ ID NO: 582), $$R_0\text{-}R_1\text{-}R_2\text{-}R_3\text{-}R_4\text{-}R_5\text{-}R_6\text{-}R_7\text{-}R_8\text{-}R_9\text{-}R_{10}\text{-}R_{11}\text{-}R_{12}\text{-}R_{13}\text{-}R_{14}\text{-}$$
$$R_{15}\text{-}R_{16}\text{-}R_{17}\text{-}R_{18}\text{-}R_{19}\text{-}R_{20}\text{-}R_{21}\text{-}R_{22}\text{-}R_{23}\text{-}R_{24}\text{-}R_{25}\text{-}R_{26}\text{-}$$
$$R_{27}\text{-}R_{28}\text{-}R_{29}\text{-}R_{30}\text{-}R_{31}\text{-}R_{32}\text{-}R_{33}\text{-}R_{34}\text{-}R_{35}\text{-}R_{36}\text{-}R_{37}\text{-}R_{38}\text{-}$$
$$R_{39}\text{-}R_{40}\text{-}R_{41}\text{-}R_{42}\text{-}R_{43}\text{-}R_{44}\text{-}R_{45}\text{-}R_{46}\text{-}[R_{47}]_x\text{-}R_{48}\text{-}R_{49}\text{-}$$
$$R_{50}\text{-}R_{51}\text{-}R_{52}\text{-}R_{53}\text{-}R_{54}\text{-}R_{55}\text{-}R_{56}\text{-}R_{57}\text{-}R_{58}\text{-}R_{59}\text{-}R_{60}\text{-}R_{61}\text{-}$$
$$R_{62}\text{-}R_{63}\text{-}R_{64}\text{-}R_{65}\text{-}R_{66}\text{-}R_{67}\text{-}R_{68}\text{-}R_{69}\text{-}R_{70}\text{-}R_{71}\text{-}R_{72}$$

wherein R is a ribonucleotide residue and the consensus for Glu is:

$R_0,R_{17}$, $R_{18}$, $R_{23}$=are absent $R_{14},R_{27},R_{40},R_{71}$=are independently A or absent;

$R_{44}$=A,C or absent;

$R_{43}$=A,C,G or absent;

$R_1,R_{31},R_{33},R_{45},R_{51},R_{66}$=are independently N or absent;

$R_{21},R_{41}$=are independently A,C,U or absent;

$R_7,R_{24},R_{25},R_{50},R_{52},R_{56},R_{63},R_{68},R_{70}$=are independently A,G or absent;

$R_5,R_{46}$=are independently A,G,U or absent;

$R_{29},R_{57},R_{67},R_{72}$=are independently A, U or absent;

$R_2,R_{39},R_{60}$=are independently C or absent;

$R_3,R_{12},R_{20},R_{26},R_{34},R_{69}$=are independently C,G or absent;

$R_6,R_{30},R_{42},R_{48},R_{65}$=are independently C,G,U or absent;

$R_4,R_{16},R_{28},R_{35},R_{37},R_{49},R_{53},R_{55},R_{58},R_{61},R_{62}$=are independently C,U or absent;

$R_9,R_{10},R_{19},R_{64}$=are independently G or absent;

$R_{15}$, $R_{22},R_{32}$=are independently G,U or absent;

$R_8,R_{11},R_{13},R_{36},R_{38},R_{54},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Glycine TREM Consensus Sequence

In an embodiment, a TREM disclosed herein comprises the sequence of Formula $I_{GLY}$ (SEQ ID NO: 583), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Gly is:

$R_0$=absent;

$R_{24}$=A or absent;

$R_3,R_0,R_{40},R_{50},R_{51}$=are independently A,C,G or absent;

$R_4,R_5,R_6,R_7,R_{12},R_{16},R_{21},R_{22},R_{26},R_{29},R_{30},R_{31},R_{32},R_{33},$ $R_{34},R_{41},R_{42},R_{43},R_{44},R_{45},R_{46},R_{48},R_{49},R_{58},R_{63},$ $R_{64},$ $R_{65},$ $R_{66},R_{67},R_{68}$=are independently N or absent;

$R_{59}$=A,C,U or absent;

$R_1,R_{10},R_{14},R_{15},R_{27},R_{56}$=are independently A,G or absent;

$R_{20},R_{25}$=are independently A,G,U or absent;

$R_{57},R_{72}$=are independently A,U or absent;

$R_{38}$, $R_{39},R_{60}$=are independently C or absent;

$R_{52}$=C,G or absent;

$R_2,R_{19},R_{37},R_{54},R_{55},R_{61},R_{62},R_{69},R_{70}$=are independently C,G,U or absent;

$R_{11},R_{13},R_{17},R_{28},R_{35},R_{36},R_{71}$=are independently C,U or absent;

$R_8,R_{18},R_{23},R_{53}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{GLY}$ (SEQ ID NO: 584), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-, $R_{68}$-$R_{69}$-$R_{70}$-$R_{71}$-$R_{72}$ wherein R is a ribonucleotide residue and the consensus for Gly is:

$R_0,R_{18},R_{23}$=are absent $R_{24},R_{27},R_{40},R_{72}$=are independently A or absent;

$R_{26}$=A,C or absent;

$R_3,R_7,R_{68}$=are independently A,C,G or absent;

$R_5,R_{30},R_{41},R_{42},R_{44},R_{49},R_{67}$=are independently A,C,G,U or absent;

$R_{31},R_{32},R_{34}$=are independently A,C,U or absent;

$R_0,R_{10},R_{14},R_{15},R_{33},R_{50},R_{56}$=are independently A,G or absent;

$R_{12}$, $R_{16},R_{22},R_{25},R_{29},R_{46}$=are independently A,G,U or absent;

$R_{57}$=A,U or absent;

$R_{17},R_{38},R_{39},R_{60},R_{61},R_{71}$=are independently C or absent;

$R_6,R_{52},R_{64},R_{66}$=are independently C,G or absent;

$R_2,R_4,R_{37},R_{48},R_{55},R_{65}$=are independently C,G,U or absent;

$R_{13}$, $R_{35},R_{43},R_{62},R_{69}$=are independently C,U or absent;

$R_1,R_{19},R_{20},R_{51},R_{70}$=are independently G or absent;

$R_{21},R_{45},R_{63}$=are independently G,U or absent;

$R_8,R_{11},R_{28},R_{36},R_{53},R_{54},R_{58},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{GLY}$ (SEQ ID NO: 585), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Gly is:

$R_0,R_{18},R_{23}$=are absent $R_{24},R_{27},R_{40},R_{72}$=are independently A or absent;

$R_{26}$=A,C or absent;

$R_3,R_7,R_{49},R_{68}$=are independently A,C,G or absent;

$R_5,R_{30},R_{41},R_{44},R_{67}$=are independently N or absent;

$R_{31},R_{32},R_{34}$=are independently A,C,U or absent;

$R_0,R_{10},R_{14},R_{15},R_{33},R_{50},R_{56}$=are independently A,G or absent;

$R_{12},R_{25},R_{29},R_{42},R_{46}$=are independently A,G,U or absent;

$R_{16},R_{57}$=are independently A,U or absent;

$R_{17},R_{38},R_{39},R_{60},R_{61},R_{71}$=are independently C or absent;

$R_6,R_{52},R_{64},R_{66}$=are independently C,G or absent;

$R_{37},R_{48},R_{65}$=are independently C,G,U or absent;

$R_2,R_4,R_{13},R_{35},R_{43},R_{55},R_{62},R_{69}$=are independently C,U or absent;

$R_1,R_{19},R_{20},R_{51},R_{70}$=are independently G or absent;

$R_{21},R_{22},R_{45},R_{63}$=are independently G,U or absent;

$R_8,R_{11},R_{28},R_{36},R_{53},R_{54},R_{58},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Histidine TREM Consensus Sequence

In an embodiment, a TREM disclosed herein comprises the sequence of Formula I$_{HIS}$ (SEQ ID NO: 586), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for His is:

$R_{23}$=absent;

$R_{14},R_{24},R_{57}$=are independently A or absent;

$R_{72}$=A,C or absent;

$R_9,R_{27},R_{43},R_{48},R_{69}$=are independently A,C,G or absent;

$R_3,R_4,R_5,R_6,R_{12},R_{25},R_{26},R_{29},R_{30},R_{31},R_{34},R_{42},$ $R_{45},R_{46},R_{49},R_{50},R_{58},$ $R_{62},R_{63},R_{66},R_{67},R_{68}$=are independently N or absent;

$R_{13},R_{21},R_{41},R_{44},R_{65}$=are independently A,C,U or absent;

$R_{40},R_{51},R_{56},R_{70}$=are independently A,G or absent;

$R_7,R_{32}$=are independently A,G,U or absent;

$R_{55},R_{60}$=are independently C or absent;

$R_{11},R_{16},R_{33},R_{64}$=are independently C,G,U or absent;

$R_2,R_{17},R_{22},R_{28},R_{35},$ $R_{53},$ $R_{59},R_{61},R_{71}$=are independently C,U or absent;

$R_1,R_{10},R_{15},R_{19},R_{20},R_{37},R_{39},R_{52}$=are independently G or absent; $R_0$=G,U or absent;

$R_8,$ $R_{18},R_{36},R_{38},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-

12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{HIS}$ (SEQ ID NO: 587), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for His is:

$R_0,R_{17},R_{18},$ $R_{23}$=are absent;

$R_7,R_{12},R_{14},R_{24},R_{27},R_{45},R_{57},R_{58},R_{63},R_{67},R_{72}$=are independently A or absent;

$R_3$=A,C,U or absent;

$R_4,R_{43},R_{56},R_{70}$=are independently A,G or absent;

$R_{49}$=A,U or absent;

$R_2,R_{28},R_{30},R_{41},R_{42},R_{44},R_{48},R_{55},R_{60},R_{66},R_{71}$=are independently C or absent;

$R_{25}$=C,G or absent;

$R_0$=C,G,U or absent;

$R_8,$ $R_{13},R_{26},R_{33},R_{35},R_{50},R_{53},R_{61},R_{68}$=are independently C,U or absent;

$R_1,R_6,R_{10},R_{15},R_{19},R_{20},R_{32},R_{34},R_{37},R_{39},R_{40},R_{46},R_{51},R_{52},$ $R_{62},R_{64},R_{69}$=are independently G or absent;

$R_{16}$=G,U or absent;

$R_5,R_{11},R_{21},R_{22},R_{29},R_{31},R_{36},R_{38},R_{54},R_{59},R_{65}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III HIS (SEQ ID NO: 588), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for His is:

$R_0$, $R_{17}$, $R_{18}$, $R_{23}$=are absent $R_7$,$R_{12}$,$R_{14}$,$R_{24}$,$R_{27}$,$R_{45}$,$R_{57}$,$R_{58}$,$R_{63}$,$R_{67}$,$R_{72}$=are independently A or absent;

$R_3$=A,C or absent;

$R_4$,$R_{43}$,$R_{56}$,$R_{70}$=are independently A,G or absent;

$R_{49}$=A,U or absent;

$R_2$,$R_{28}$,$R_{30}$,$R_{41}$,$R_{42}$,$R_{44}$,$R_{48}$,$R_{55}$,$R_{60}$,$R_{66}$,$R_{71}$=are independently C or absent;

$R_8$,$R_0$,$R_{26}$,$R_{33}$,$R_{35}$,$R_{50}$,$R_{61}$,$R_{65}$=are independently C,U or absent;

$R_1$,$R_6$,$R_{10}$,$R_{15}$,$R_{19}$,$R_{20}$,$R_{25}$,$R_{32}$,$R_{34}$,$R_{37}$,$R_{39}$,$R_{40}$,$R_{46}$,$R_{51}$, $R_{52}$,$R_{62}$,$R_{64}$,$R_{69}$=are independently G or absent;

$R_5$,$R_1$,$R_{13}$,$R_{16}$,$R_{21}$,$R_{22}$,$R_{29}$,$R_{31}$,$R_{36}$,$R_{38}$,$R_{53}$,$R_{54}$,$R_{59}$, $R_{65}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Isoleucine TREM Consensus Sequence

In an embodiment, a TREM disclosed herein comprises the sequence of Formula I$_{ILE}$ (SEQ ID NO: 589), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ile is:

$R_{23}$-absent;

$R_{38}$, $R_{41}$,$R_{57}$,$R_{72}$=are independently A or absent;

$R_1$,$R_{26}$=are independently A,C,G or absent;

$R_0$,$R_3$,$R_4$,$R_6$,$R_{16}$,$R_{31}$,$R_{32}$,$R_{34}$,$R_{37}$,$R_{42}$,$R_{43}$,$R_{44}$,$R_{45}$,$R_{46}$, $R_{48}$,$R_{49}$,$R_{50}$,$R_{58}$,$R_{59}$,$R_{62}$,$R_{63}$,$R_{64}$,$R_{66}$,$R_{67}$,$R_{68}$, $R_{69}$=are independently N or absent;

$R_{22}$,$R_{61}$,$R_{65}$=are independently A,C,U or absent;

$R_9$,$R_{14}$,$R_{15}$,$R_{24}$,$R_{27}$,$R_{40}$=are independently A,G or absent;

$R_7$,$R_{25}$,$R_{29}$,$R_{51}$,$R_{56}$=are independently A,G,U or absent;

$R_{18}$,$R_{54}$=are independently A,U or absent;

$R_{60}$=C or absent;

$R_2$,$R_{52}$,$R_{70}$=are independently C,G or absent;

$R_5$,$R_{12}$,$R_{21}$,$R_{30}$,$R_{33}$,$R_{71}$=are independently C,G,U or absent;

$R_{11}$,$R_{13}$, $R_{17}$,$R_{28}$,$R_{35}$,$R_{53}$,$R_{55}$=are independently C,U or absent;

$R_{10}$,$R_{19}$,$R_{20}$=are independently G or absent;

$R_8$,$R_{36}$,$R_{39}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{ILE}$ (SEQ ID NO: 590), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ile is:

$R_0$,$R_{18}$, $R_{23}$=are absent $R_{24}$,$R_{38}$,$R_{40}$,$R_{41}$,$R_{57}$,$R_{72}$=are independently A or absent;

$R_{26}$,$R_{65}$=are independently A,C or absent;

$R_{58}$,$R_{59}$,$R_{67}$=are independently N or absent;

$R_{22}$=A,C,U or absent;

$R_6$,$R_0$,$R_{14}$,$R_{15}$,$R_{29}$,$R_{34}$,$R_{43}$,$R_{46}$,$R_{48}$,$R_{50}$,$R_{51}$,$R_{63}$, $R_{69}$=are independently A,G or absent;

$R_{37}$,$R_{56}$=are independently A,G,U or absent;

$R_{54}$=A,U or absent;

$R_{28}$, $R_{35}$,$R_{60}$,$R_{62}$,$R_{71}$=are independently C or absent;

$R_2$,$R_{52}$,$R_{70}$=are independently C,G or absent;

$R_5$=C,G,U or absent;

$R_3$,$R_4$,$R_{11}$,$R_{13}$,$R_{17}$,$R_{21}$,$R_{30}$,$R_{42}$,$R_{44}$,$R_{45}$,$R_{49}$,$R_{53}$,$R_{55}$,$R_{61}$, $R_{64}$,$R_{66}$=are independently C,U or absent;

$R_1$,$R_{10}$,$R_{19}$,$R_{20}$,$R_{25}$,$R_{27}$,$R_{31}$,$R_{68}$=are independently G or absent;

$R_7$,$R_{12}$,$R_{32}$=are independently G,U or absent;

$R_8$,$R_{16}$,$R_{33}$,$R_{36}$,$R_{39}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{ILE}$ (SEQ ID NO: 591), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-

$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ile is:

$R_0$,$R_{18}$, $R_{23}$=are absent $R_{14}$,$R_{24}$,$R_{38}$,$R_{40}$,$R_{41}$,$R_{57}$,$R_{72}$=are independently A or absent;

$R_{26}$,$R_{65}$=are independently A,C or absent;

$R_{22}$,$R_{59}$=are independently A,C,U or absent;

$R_6$,$R_0$,$R_{15}$,$R_{34}$,$R_{43}$,$R_{46}$,$R_{51}$,$R_{56}$,$R_{63}$,$R_{69}$=are independently A,G or absent;

$R_{37}$=A,G,U or absent;

$R_{13}$, $R_{28}$,$R_{35}$,$R_{44}$,$R_{55}$,$R_{60}$,$R_{62}$,$R_{71}$=are independently C or absent;

$R_2$,$R_5$,$R_0$=are independently C,G or absent;

$R_{58}$,$R_{67}$=are independently C,G,U or absent;

$R_3$,$R_4$,$R_{11}$,$R_{17}$,$R_{21}$,$R_{30}$,$R_{42}$,$R_{45}$,$R_{49}$,$R_{53}$,$R_{61}$,$R_{64}$,$R_{66}$=are independently C,U or absent;

$R_1$,$R_{10}$,$R_{19}$,$R_{20}$,$R_{25}$,$R_{27}$,$R_{29}$,$R_{31}$,$R_{32}$,$R_{48}$,$R_{50}$,$R_{52}$, $R_{68}$=are independently G or absent;

$R_7$,$R_{12}$=are independently G,U or absent;

$R_8$,$R_{16}$,$R_{33}$,$R_{36}$,$R_{39}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Methionine TREM Consensus Sequence

In an embodiment, a TREM disclosed herein comprises the sequence of Formula I$_{MET}$ (SEQ ID NO: 592), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Met is:

$R_0$,$R_{23}$=are absent;

$R_{14}$,$R_{38}$,$R_{40}$,$R_{57}$=are independently A or absent;

$R_{60}$=A,C or absent;

$R_{33}$,$R_{48}$, $R_{70}$=are independently A,C,G or absent;

$R_1$,$R_3$,$R_4$,$R_5$,$R_6$,$R_{11}$,$R_{12}$,$R_{16}$, $R_{17}$,$R_{21}$,$R_{22}$, $R_{26}$,$R_{27}$,$R_{29}$, $R_{30}$,$R_{31}$,$R_{32}$,$R_{42}$,$R_{44}$,$R_{45}$,$R_{46}$,$R_{49}$,$R_{50}$,$R_{58}$, $R_{62}$,$R_{63}$, $R_{66}$,$R_{67}$,$R_{68}$,$R_{69}$,$R_{71}$=are independently N or absent;

$R_{18}$,$R_{35}$,$R_{41}$,$R_{59}$,$R_{65}$=are independently A,C,U or absent;

$R_0$,$R_{15}$,$R_{51}$=are independently A,G or absent;

$R_7$,$R_{24}$,$R_{25}$,$R_{34}$,$R_{53}$,$R_{56}$=are independently A,G,U or absent;

$R_{72}$=A,U or absent;

$R_{37}$=C or absent;

$R_{10}$,$R_{55}$=are independently C,G or absent;

$R_2$,$R_{13}$,$R_{28}$,$R_{43}$,$R_{64}$=are independently C,G,U or absent;

$R_{36}$,$R_{61}$=are independently C,U or absent;

$R_{19}$,$R_{20}$,$R_{52}$=are independently G or absent;

$R_8$,$R_{39}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{MET}$ (SEQ ID NO: 593), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Met is:

$R_0$,$R_{18}$, $R_{22}$, $R_{23}$=are absent $R_{14}$,$R_{24}$,$R_{38}$,$R_{40}$,$R_{41}$,$R_{57}$,$R_{72}$=are independently A or absent;

$R_{59}$,$R_{60}$,$R_{62}$,$R_{65}$=are independently A,C or absent;

$R_6$,$R_{45}$,$R_{67}$=are independently A,C,G or absent;

$R_4$=N or absent;

$R_{21}$,$R_{42}$=are independently A,C,U or absent;

$R_1$,$R_9$,$R_{27}$,$R_{29}$,$R_{32}$,$R_{46}$,$R_{51}$=are independently A,G or absent;

$R_{17}$,$R_{49}$,$R_{53}$,$R_{56}$,$R_{55}$=are independently A,G,U or absent;

$R_{63}$=A,U or absent;

$R_3$,$R_{13}$,$R_{37}$=are independently C or absent;

$R_{48}$, $R_{55}$,$R_{64}$,$R_{70}$=are independently C,G or absent;

$R_2$,$R_5$,$R_{66}$,$R_{68}$=are independently C,G,U or absent;

$R_{11}$,$R_{16}$,$R_{26}$,$R_{28}$,$R_{30}$,$R_{31}$,$R_{35}$,$R_{36}$,$R_{43}$,$R_{44}$,$R_{61}$,$R_{71}$=are independently C,U or absent;

$R_{10}$,$R_{12}$,$R_{15}$,$R_{19}$,$R_{20}$,$R_{25}$,$R_{33}$,$R_{52}$,$R_{69}$=are independently G or absent;

$R_7$,$R_{34}$,$R_{50}$=are independently G,U or absent; $R_8$,$R_{39}$, $R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III MET (SEQ ID NO: 594), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Met is:

$R_0$,$R_{18}$, $R_{22}$,$R_{23}$=are absent $R_{14}$,$R_{24}$,$R_{38}$,$R_{40}$,$R_{41}$,$R_{57}$,$R_{72}$=are independently A or absent;

$R_{59}$,$R_{62}$,$R_{65}$=are independently A,C or absent;

$R_6$,$R_{67}$=are independently A,C,G or absent;

$R_4$,$R_{21}$=are independently A,C,U or absent;

$R_1$,$R_0$,$R_{27}$,$R_{29}$,$R_{32}$,$R_{45}$,$R_{46}$,$R_{51}$=are independently A,G or absent;

$R_{17}$,$R_{56}$,$R_{58}$=are independently A,G,U or absent;

$R_{49}$,$R_{53}$,$R_{63}$=are independently A,U or absent;

$R_3$,$R_{13}$,$R_{26}$,$R_{37}$,$R_{43}$,$R_{60}$=are independently C or absent;

$R_2$,$R_{48}$,$R_{55}$,$R_{64}$,$R_{70}$=are independently C,G or absent;

$R_5$,$R_{66}$=are independently C,G,U or absent;

$R_{11}$,$R_{16}$,$R_{28}$,$R_{30}$,$R_{31}$,$R_{35}$,$R_{36}$,$R_{42}$,$R_{44}$,$R_{61}$,$R_{71}$=are independently C,U or absent;

$R_{10}$, $R_{12}$, $R_{15}$,$R_{19}$,$R_{20}$,$R_{25}$,$R_{33}$,$R_{52}$,$R_{69}$=are independently G or absent;

$R_7$,$R_{34}$,$R_{50}$,$R_{68}$=are independently G,U or absent;

$R_8$,$R_{39}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Leucine TREM Consensus Sequence

In an embodiment, a TREM disclosed herein comprises the sequence of Formula I LEU (SEQ ID NO: 595), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Leu is:

$R_0$=absent;

$R_{38}$,$R_{57}$=are independently A or absent;

$R_{60}$=A,C or absent;

$R_1$,$R_{13}$,$R_{27}$,$R_{48}$,$R_{51}$,$R_{56}$=are independently A,C,G or absent;

$R_2$,$R_3$,$R_4$,$R_5$,$R_6$,$R_7$,$R_0$,$R_{10}$,$R_{11}$,$R_{12}$,$R_{16}$,$R_{23}$,$R_{26}$,$R_{28}$,$R_{29}$, $R_{30}$,$R_{31}$,$R_{32}$,$R_{33}$,$R_{34}$,$R_{37}$,$R_{41}$,$R_{42}$,$R_{43}$, $R_{44}$, $R_{45}$,$R_{46}$, $R_{49}$,$R_{50}$,$R_{58}$,$R_{62}$,$R_{63}$,$R_{65}$,$R_{66}$,$R_{67}$,$R_{68}$,$R_{69}$,$R_{70}$=are independently N or absent;

$R_{17}$,$R_{18}$,$R_{21}$,$R_{22}$,$R_{25}$,$R_{35}$,$R_{55}$=are independently A,C,U or absent;

$R_{14}$,$R_{15}$,$R_{39}$,$R_{72}$=are independently A,G or absent;

$R_{24}$,$R_{40}$=are independently A,G,U or absent;

$R_{52}$,$R_{61}$,$R_{64}$,$R_{71}$=are independently C,G,U or absent;

$R_{36}$,$R_{53}$,$R_{59}$=are independently C,U or absent;

$R_{19}$=G or absent;

$R_{20}$=G,U or absent;

$R_8$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II LEU (SEQ ID NO: 596), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Leu is:

$R_0$=absent $R_{38}$,$R_{57}$,$R_{72}$=are independently A or absent;

$R_{60}$=A,C or absent;

$R_4$,$R_5$,$R_{48}$,$R_{50}$,$R_{56}$,$R_{69}$=are independently A,C,G or absent;

$R_6$,$R_{33}$,$R_{41}$,$R_{43}$,$R_{46}$,$R_{49}$,$R_{58}$,$R_{63}$,$R_{66}$,$R_{70}$=are independently N or absent;

$R_{11}$,$R_{12}$,$R_{17}$,$R_{21}$,$R_{22}$,$R_{28}$,$R_{31}$,$R_{37}$,$R_{44}$,$R_{55}$=are independently A,C,U or absent;

$R_1$,$R_9$,$R_{14}$,$R_{15}$,$R_{24}$,$R_{27}$,$R_{34}$,$R_{39}$=are independently A,G or absent;

$R_7$,$R_{29}$,$R_{32}$,$R_{40}$,$R_{45}$=are independently A,G,U or absent;

$R_{25}$=A,U or absent;

$R_{13}$=C,G or absent;

$R_2$,$R_3$,$R_{16}$,$R_{26}$,$R_{30}$,$R_{52}$,$R_{62}$,$R_{64}$,$R_{65}$,$R_{67}$,$R_{68}$=are independently C,G,U or absent;

$R_{18}$,$R_{35}$, $R_{42}$,$R_{53}$, $R_{59}$,$R_{61}$,$R_{71}$=are independently C,U or absent;

$R_{19}$,$R_{51}$=are independently G or absent;

$R_{10}$,$R_{20}$=are independently G,U or absent;

$R_8$,$R_{23}$,$R_{36}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{LEU}$ (SEQ ID NO: 597), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Leu is:

$R_0$=absent $R_{38}$, $R_{57}$,$R_{72}$=are independently A or absent;

$R_{60}$=A,C or absent;

$R_4$,$R_5$,$R_{48}$,$R_{50}$,$R_{56}$,$R_{58}$,$R_{69}$=are independently A,C,G or absent;

$R_6$,$R_{33}$, $R_{43}$, $R_{46}$,$R_{49}$,$R_{63}$,$R_{66}$,$R_{70}$=are independently N or absent;

$R_{11}$, $R_{12}$, $R_{17}$,$R_{21}$,$R_{22}$,$R_{28}$,$R_{31}$,$R_{37}$,$R_{41}$,$R_{44}$,$R_{55}$=are independently A,C,U or absent;

$R_1$,$R_9$,$R_{14}$,$R_{15}$,$R_{24}$,$R_{27}$,$R_{34}$,$R_{39}$=are independently A,G or absent;

$R_7$,$R_{29}$,$R_{32}$,$R_{40}$,$R_{45}$=are independently A,G,U or absent;

$R_{25}$=A,U or absent;

$R_{13}$=C,G or absent;

$R_2$,$R_3$,$R_{16}$,$R_{30}$,$R_{52}$,$R_{62}$,$R_{64}$,$R_{67}$,$R_{68}$=are independently C,G,U or absent;

$R_{18}$, $R_{35}$,$R_{42}$,$R_{53}$,$R_{59}$,$R_{61}$,$R_{65}$,$R_{71}$=are independently C,U or absent;

$R_{19}$,$R_{51}$=are independently G or absent;

$R_{10}$,$R_{20}$,$R_{26}$=are independently G,U or absent;

$R_8$,$R_{23}$,$R_{36}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Lysine TREM Consensus Sequence

In an embodiment, a TREM disclosed herein comprises the sequence of Formula I$_{LYS}$ (SEQ ID NO: 598), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-

$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Lys is:

$R_0$=absent $R_{14}$=A or absent;

$R_{40}$,$R_{41}$=are independently A,C or absent;

$R_{34}$, $R_{43}$,$R_{51}$=are independently A,C,G or absent;

$R_1$,$R_2$,$R_3$,$R_4$,$R_5$,$R_6$,$R_7$,$R_{11}$,$R_{12}$,$R_{16}$,$R_{21}$,$R_{26}$,$R_{30}$,$R_{31}$,$R_{32}$,$R_{44}$,$R_{45}$,$R_{46}$,$R_{48}$,$R_{49}$,$R_{50}$,$R_{58}$,$R_{62}$,$R_{63}$,$R_{65}$, $R_{66}$, $R_{67}$, $R_{68}$,$R_{69}$,$R_{70}$=are independently N or absent;

$R_{13}$,$R_{17}$,$R_{59}$,$R_{71}$=are independently A,C,U or absent;

$R_0$,$R_{15}$,$R_{19}$,$R_{20}$,$R_{25}$,$R_{27}$,$R_{52}$,$R_{56}$=are independently A,G or absent;

$R_{24}$,$R_{29}$,$R_{72}$=are independently A,G,U or absent;

$R_{18}$,$R_{57}$=are independently A, U or absent;

$R_{10}$,$R_{33}$=are independently C,G or absent;

$R_{42}$, $R_{61}$,$R_{64}$=are independently C,G,U or absent;

$R_{28}$,$R_{35}$,$R_{36}$,$R_{37}$,$R_{53}$,$R_{55}$,$R_{60}$=are independently C,U or absent;

$R_8$,$R_{22}$,$R_{23}$,$R_{38}$,$R_{39}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{LYS}$ (SEQ ID NO: 599), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Lys is:

$R_0$,$R_{18}$, $R_{23}$=are absent $R_{14}$=A or absent;

$R_{40}$,$R_{41}$,$R_{43}$=are independently A,C or absent;

$R_3$,$R_7$=are independently A,C,G or absent;

$R_1$,$R_6$,$R_{11}$,$R_{31}$,$R_{45}$,$R_{48}$,$R_{49}$,$R_{63}$,$R_{65}$,$R_{66}$,$R_{68}$=are independently N or absent;

$R_2$,$R_{12}$,$R_{13}$,$R_{17}$,$R_{44}$,$R_{67}$,$R_{71}$=are independently A,C,U or absent;

$R_9$,$R_{15}$,$R_{19}$,$R_{20}$,$R_{25}$,$R_{27}$,$R_{34}$,$R_{50}$,$R_{52}$,$R_{56}$,$R_{70}$,$R_{72}$=are independently A,G or absent;

$R_5$,$R_{24}$,$R_{26}$,$R_{29}$,$R_{32}$,$R_{46}$,$R_{69}$=are independently A,G,U or absent;

$R_{57}$=A,U or absent;

$R_{10}$,$R_{61}$=are independently C,G or absent;

$R_4$,$R_{16}$,$R_{21}$,$R_{30}$,$R_{58}$,$R_{64}$=are independently C,G,U or absent;

$R_{28}$, $R_{35}$,$R_{36}$,$R_{37}$,$R_{42}$,$R_{53}$,$R_{55}$,$R_{59}$,$R_{60}$,$R_{62}$=are independently C,U or absent;

$R_{33},R_{51}$=are independently G or absent;

$R_8$-G,U or absent;

$R_{22},R_{38},R_{39},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{LYS}$ (SEQ ID NO: 600), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Lys is:

$R_0,R_{18},R_{23}$=absent $R_0,R_{14},R_{34},R_{41}$=are independently A or absent;

$R_{40}$=A,C or absent;

$R_1,R_3,R_7,R_{31}$=are independently A,C,G or absent;

$R_{48},R_{65},R_{68}$=are independently N or absent;

$R_2,R_{13},R_{17},R_{44},R_{63},R_{66}$=are independently A,C,U or absent;

$R_5,R_{15},R_{19},R_{20},R_{25},R_{27},R_{29},R_{50},R_{52},R_{56},R_{70},R_{72}$=are independently A,G or absent;

$R_6,R_{24},R_{32},R_{49}$=are independently A,G,U or absent;

$R_{12},R_{26},R_{46},R_{57}$=are independently A,U or absent;

$R_{11},R_{28},R_{35},R_{43}$=are independently C or absent;

$R_{10},R_{45},R_{61}$=are independently C,G or absent;

$R_4,R_{21},R_{64}$=are independently C,G,U or absent;

$R_{37},R_{53},R_{55},R_{59},R_{60},\ R_{62},\ R_{67},R_{71}$=are independently C,U or absent;

$R_{33},R_{51}$=are independently G or absent;

$R_8,\ R_{30},R_{58},R_{69}$=are independently G,U or absent;

$R_{16},R_{22},R_{36},R_{38},R_{39},R_{42},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Phenylalanine TREM Consensus Sequence

In an embodiment, a TREM disclosed herein comprises the sequence of Formula I$_{PHE}$ (SEQ ID NO: 601), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Phe is:

$R_0,R_{23}$=are absent $R_0,R_{14},R_{38},R_{39},R_{57},R_{72}$=are independently A or absent;

$R_{71}$=A,C or absent;

$R_{41},R_{70}$=are independently A,C,G or absent;

$R_4,R_5,R_6,R_{30},R_{31},R_{32},R_{34},R_{42},R_{44},R_{45},R_{46},R_{48},R_{49},R_{58},R_{62},R_{63},R_{66},R_{67},R_{68},R_{69}$=are independently N or absent;

$R_{16},R_{61},R_{65}$=are independently A,C,U or absent;

$R_{15},R_{26},R_{27},R_{29},R_{40},R_{56}$=are independently A,G or absent;

$R_7,R_{51}$=are independently A,G,U or absent;

$R_{22},R_{24}$=are independently A,U or absent;

$R_{55},R_{60}$=are independently C or absent;

$R_2,R_3,R_{21},R_{33},R_{43},R_{50},R_{64}$=are independently C,G,U or absent;

$R_1,R_{12},\ R_{13},\ R_{17},R_{28},R_{35},R_{36},R_{59}$=are independently C,U or absent;

$R_{10},R_{19},R_{20},R_{25},R_{37},R_{52}$=are independently G or absent;

$R_1$=G,U or absent;

$R_8,R_{18},R_{53},R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II PHE (SEQ ID NO: 602), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Phe is:

$R_0,R_{18},R_{23}$=absent $R_{14},\ R_{24},\ R_{38},R_{39},R_{57},R_{72}$=are independently A or absent;

$R_{46},R_{71}$=are independently A,C or absent;

$R_4,R_{70}$=are independently A,C,G or absent;

$R_{45}$=A,C,U or absent;

$R_6, R_7, R_{15}, R_{26}, R_{27}, R_{32}, R_{34}, R_{40}, R_{41}, R_{56}, R_{69}$=are independently A,G or absent;

$R_{29}$=A,G,U or absent;

$R_5, R_9, R_{67}$=are independently A,U or absent;

$R_{35}, R_{49}, R_{55}, R_{60}$=are independently C or absent;

$R_{21}, R_{43}, R_{62}$=are independently C,G or absent;

$R_2, R_{33}, R_{68}$=are independently C,G,U or absent;

$R_3, R_{11}, R_{12}, R_{13}, R_{28}, R_{30}, R_{36}, R_{42}, R_{44}, R_{48}, R_{58}, R_{59}, R_{61}, R_{66}$=are independently C,U or absent;

$R_{10}$, $R_{19}$, $R_{20}$, $R_{25}$, $R_{37}, R_{51}$, $R_{52}$, $R_{63}$, $R_{64}$=are independently G or absent;

$R_1, R_{31}, R_{50}$=are independently G,U or absent;

$R_8, R_{16}$, $R_{17}, R_{22}$, $R_{53}$, $R_{54}$, $R_{65}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{PHE}$ (SEQ ID NO: 603), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Phe is:

$R_0, R_{18}, R_{22}, R_{23}$=absent $R_5, R_7, R_{14}, R_{24}, R_{26}, R_{32}, R_{34}, R_{38}, R_{39}, R_{41}, R_{57}, R_{72}$=are independently A or absent;

$R_{46}$=A,C or absent;

$R_{70}$=A,C,G or absent;

$R_4, R_6$, $R_{15}, R_{56}, R_{69}$=are independently A,G or absent;

$R_9, R_{45}$=are independently A,U or absent;

$R_2, R_{11}, R_{13}, R_{35}, R_{43}, R_{49}, R_{55}, R_{60}, R_{68}, R_{71}$=are independently C or absent;

$R_{33}$=C,G or absent;

$R_3, R_{28}, R_{36}, R_{48}, R_{55}, R_{59}, R_{61}$=are independently C,U or absent;

$R_1, R_{10}, R_{19}, R_{20}, R_{21}, R_{25}, R_{27}, R_{29}, R_{37}, R_{40}, R_{51}, R_{52}, R_{62}, R_{63}, R_{64}$=are independently G or absent;

$R_8, R_{12}, R_{16}, R_{17}, R_{30}, R_{31}, R_{42}, R_{44}, R_{50}, R_{53}, R_{54}, R_{65}, R_{66}, R_{67}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Proline TREM Consensus Sequence

In an embodiment, a TREM disclosed herein comprises the sequence of Formula I$_{PRO}$ (SEQ ID NO: 604), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Pro is:

$R_0$=absent $R_{14}, R_{57}$=are independently A or absent;

$R_{70}, R_{72}$=are independently A,C or absent;

$R_9, R_{26}, R_{27}$=are independently A,C,G or absent;

$R_4, R_5, R_6, R_{16}, R_{21}, R_{29}, R_{30}, R_{31}, R_{32}, R_{33}, R_{34}, R_{37}, R_{41}, R_{42}, R_{43}, R_{44}, R_{45}, R_{46}, R_{48}, R_{49}, R_{50}, R_{58}, R_{61}, R_{62}$, $R_{63}, R_{64}, R_{66}, R_{67}, R_{68}$=are independently N or absent;

$R_{35}, R_{65}$=are independently A,C,U or absent;

$R_{24}$, $R_{40}, R_{56}$=are independently A,G or absent;

$R_7, R_{25}, R_{51}$=are independently A,G,U or absent;

$R_{55}, R_{60}$=are independently C or absent;

$R_1, R_3, R_{71}$=are independently C,G or absent;

$R_{11}$, $R_{12}$, $R_{20}, R_{69}$=are independently C,G, U or absent;

$R_{13}$, $R_{17}, R_{18}, R_{22}, R_{23}, R_{28}, R_{59}$=are independently C,U or absent;

$R_{10}$, $R_{15}$, $R_{19}, R_{38}$, $R_{39}, R_{52}$=are independently G or absent;

$R_2$=are independently G,U or absent;

$R_8, R_{36}, R_{53}, R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{PRO}$ (SEQ ID NO: 605), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Pro is:

$R_0, R_{17}, R_{18}, R_{22}, R_{23}$=absent;

$R_{14}, R_{45}, R_{56}, R_{57}, R_{58}, R_{65}, R_{68}$=are independently A or absent;

$R_{61}$=A,C,G or absent;

$R_{43}$=N or absent;

$R_{37}$=A, C,U or absent;

$R_{24}, R_{27}, R_{33}, R_{40}, R_{44}, R_{63}$=are independently A,G or absent;

$R_3, R_{12}, R_{30}, R_{32}, R_{48}, R_{55}, R_{60}, R_{70}, R_{71}, R_{72}$=are independently C or absent;

$R_5, R_{34}, R_{42}, R_{66}$=are independently C,G or absent;

$R_{20}$=C,G,U or absent;

$R_{35}, R_{41}, R_{49}, R_{62}$=are independently C,U or absent;

$R_1, R_2, R_6, R_9, R_{10}, R_{15}, R_{19}, R_{26}, R_{38}, R_{39}, R_{46}, R_{50}, R_{51}, R_{52}, R_{64}, R_{67}, R_{69}$=are independently G or absent;

$R_{11}, R_{16}$=are independently G,U or absent;

$R_4, R_7, R_8, R_{13}, R_{21}, R_{25}, R_{28}, R_{29}, R_{31}, R_{36}, R_{53}, R_{54}, R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{PRO}$ (SEQ ID NO: 606), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Pro is:

$R_0, R_{17}, R_{18}, R_{22}, R_{23}$-absent $R_{14}, R_{45}, R_{56}, R_{57}, R_{58}, R_{65}, R_{68}$=are independently A or absent;

$R_{37}$=A,C,U or absent;

$R_{24}, R_{27}, R_{40}$=are independently A,G or absent;

$R_3, R_5, R_{12}, R_{30}, R_{32}, R_{48}, R_{49}, R_{55}, R_{60}, R_{61}, R_{62}, R_{66}, R_{70}, R_{71}, R_{72}$=are independently C or absent;

$R_{34}, R_{42}$=are independently C,G or absent;

$R_{43}$=C,G,U or absent;

$R_{41}$=C,U or absent;

$R_1, R_2, R_6, R_9, R_{10}, R_{15}, R_{19}, R_{20}, R_{26}, R_{33}, R_{38}, R_{39}, R_{44}, R_{46}, R_{50}, R_{51}, R_{52}, R_{63}, R_{64}, R_{67}, R_{69}$=are independently G or absent;

$R_{16}$=G,U or absent;

$R_4, R_7, R_8, R_{11}, R_{13}, R_{21}, R_{25}, R_{28}, R_{29}, R_{31}, R_{35}, R_{36}, R_{53}, R_{54}, R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Serine TREM Consensus Sequence

In an embodiment, a TREM disclosed herein comprises the sequence of Formula I$_{SER}$ (SEQ ID NO: 607), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ser is:

$R_0$-absent;

$R_{14}, R_{24}, R_{57}$=are independently A or absent;

$R_{41}$=A,C or absent;

$R_2, R_3, R_4, R_5, R_6, R_7, R_9, R_{10}, R_{11}, R_{12}, R_{13}, R_{16}, R_{21}, R_{25}, R_{26}, R_{27}, R_{28}, R_{30}, R_{31}, R_{32}, R_{33}, R_{34}, R_{37}, R_{42}, R_{43}, R_{44}, R_{45}, R_{46}, R_{48}, R_{49}, R_{50}, R_{62}, R_{63}, R_{64}, R_{65}, R_{66}, R_{67}, R_{68}, R_{69}, R_{70}$=are independently N or absent;

$R_{18}$=A,C,U or absent;

$R_1, R_{40}, R_{51}, R_{56}$=are independently A,G or absent;

$R_1, R_{29}, R_{58}, R_{72}$=are independently A,G,U or absent;

$R_{39}$=A,U or absent;

$R_{60}$=C or absent;

$R_{38}$=C,G or absent;

$R_{17}, R_{22}, R_{23}, R_{71}$=are independently C,G,U or absent;

$R_8, R_{35}, R_{36}, R_{55}, R_{59}, R_{61}$=are independently C,U or absent;

$R_{19}, R_{20}$=are independently G or absent;

$R_{52}$=G,U or absent;

$R_{53}, R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{SER}$ (SEQ ID NO: 608), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-

$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-
$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-
$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-
$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ser is:

$R_0$,$R_{23}$-absent $R_{14}$,$R_{24}$,$R_{41}$,$R_{57}$=are independently A or absent;

$R_{44}$=A,C or absent;

$R_{25}$, $R_{45}$,$R_{48}$=are independently A,C,G or absent;

$R_2$,$R_3$,$R_4$,$R_5$,$R_{37}$,$R_{50}$,$R_{62}$,$R_{66}$,$R_{67}$,$R_{69}$,$R_{70}$=are independently N or absent;

$R_{12}$,$R_{28}$,$R_{65}$=are independently A,C,U or absent;

$R_9$,$R_{15}$,$R_{29}$,$R_{34}$,$R_{40}$,$R_{56}$,$R_{63}$=are independently A,G or absent;

$R_7$,$R_{26}$,$R_{30}$,$R_{33}$,$R_{46}$,$R_{58}$,$R_{72}$=are independently A,G,U or absent;

$R_{39}$-A,U or absent;

$R_{11}$,$R_{35}$,$R_{60}$,$R_{61}$=are independently C or absent;

$R_{13}$,$R_{38}$=are independently C,G or absent;

$R_6$,$R_{17}$,$R_{31}$,$R_{43}$,$R_{64}$,$R_{68}$=are independently C,G,U or absent;

$R_{36}$,$R_{42}$,$R_{49}$,$R_{55}$,$R_{59}$,$R_{71}$=are independently C,U or absent;

$R_{10}$,$R_{19}$,$R_{20}$,$R_{27}$,$R_{51}$=are independently G or absent;

$R_1$,$R_{16}$,$R_{32}$,$R_{52}$=are independently G,U or absent;

$R_8$,$R_{18}$,$R_{21}$,$R_{22}$,$R_{53}$,$R_{54}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{SER}$ (SEQ ID NO: 609), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-
$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-
$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-
$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-
$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-
$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Ser is:

$R_0$,$R_{23}$=absent $R_{14}$,$R_{24}$,$R_{41}$,$R_{57}$,$R_{58}$=are independently A or absent;

$R_{44}$=A,C or absent;

$R_{25}$,$R_{48}$=are independently A,C,G or absent;

$R_2$,$R_3$,$R_5$,$R_{37}$,$R_{66}$,$R_{67}$,$R_{69}$,$R_{70}$=are independently N or absent;

$R_{12}$,$R_{28}$,$R_{62}$=are independently A,C,U or absent;

$R_7$,$R_9$,$R_{15}$,$R_{29}$,$R_{33}$,$R_{34}$,$R_{40}$,$R_{45}$,$R_{56}$,$R_{63}$=are independently A,G or absent;

$R_4$,$R_{26}$,$R_{46}$,$R_{50}$=are independently A,G,U or absent;

$R_{30}$,$R_{39}$=are independently A,U or absent;

$R_{11}$,$R_{17}$,$R_{35}$,$R_{60}$,$R_{61}$=are independently C or absent;

$R_{13}$,$R_{38}$=are independently C,G or absent;

$R_6$,$R_{64}$=are independently C,G,U or absent;

$R_{31}$,$R_{42}$,$R_{43}$,$R_{49}$,$R_{55}$,$R_{59}$,$R_{65}$,$R_{68}$,$R_{71}$=are independently C,U or absent;

$R_{10}$,$R_{19}$,$R_{20}$,$R_{27}$,$R_{51}$,$R_{52}$=are independently G or absent;

$R_1$,$R_{16}$,$R_{32}$,$R_{72}$=are independently G,U or absent;

$R_8$,$R_{18}$,$R_{21}$,$R_{22}$,$R_{36}$,$R_{53}$,$R_{54}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Threonine TREM Consensus Sequence

In an embodiment, a TREM disclosed herein comprises the sequence of Formula I$_{THR}$ (SEQ ID NO: 610), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-
$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-
$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-
$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-
$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-
$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Thr is:

$R_0$,$R_{23}$=absent $R_{14}$,$R_{41}$,$R_{57}$=are independently A or absent;

$R_{56}$,$R_{70}$=are independently A,C,G or absent;

$R_4$,$R_5$,$R_6$,$R_7$,$R_{12}$,$R_{16}$,$R_{26}$,$R_{30}$,$R_{31}$,$R_{32}$,$R_{34}$,$R_{37}$,$R_{42}$,$R_{44}$, $R_{45}$,$R_{46}$,$R_{48}$,$R_{49}$,$R_{50}$,$R_{58}$,$R_{62}$,$R_{63}$,$R_{64}$,$R_{65}$,$R_{66}$, $R_{67}$, $R_{68}$,$R_{72}$=are independently N or absent;

$R_{13}$,$R_{17}$,$R_{21}$,$R_{35}$,$R_{61}$=are independently A,C,U or absent;

$R_1$,$R_9$,$R_{24}$,$R_{27}$,$R_{29}$,$R_{69}$=are independently A,G or absent;

$R_{15}$, $R_{25}$,$R_{51}$=are independently A,G,U or absent;

$R_{40}$,$R_{53}$=are independently A,U or absent;

$R_{33}$,$R_{43}$=are independently C,G or absent;

$R_2$,$R_3$,$R_{59}$=are independently C,G,U or absent;

$R_{11}$,$R_{18}$,$R_{22}$,$R_{28}$,$R_{36}$,$R_{54}$,$R_{55}$,$R_{60}$,$R_{71}$=are independently C,U or absent;

$R_{10}$,$R_{20}$,$R_{38}$,$R_{52}$=are independently G or absent;

$R_{19}$=G,U or absent;

$R_8$,$R_{39}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II$_{THR}$ (SEQ ID NO: 611), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Thr is:

$R_0$,$R_{18}$,$R_{23}$=absent $R_{14}$,$R_{41}$,$R_{57}$=are independently A or absent;

$R_9$,$R_{42}$,$R_{44}$,$R_{48}$,$R_{56}$,$R_{70}$=are independently A,C,G or absent;

$R_4$,$R_6$,$R_{12}$,$R_{26}$,$R_{49}$,$R_{58}$,$R_{63}$,$R_{64}$,$R_{66}$,$R_{68}$=are independently N or absent;

$R_{13}$,$R_{21}$,$R_{31}$,$R_{37}$,$R_{62}$=are independently A,C,U or absent;

$R_1$,$R_{15}$,$R_{24}$,$R_{27}$,$R_{29}$,$R_{46}$,$R_{51}$,$R_{69}$=are independently A,G or absent;

$R_7$,$R_{25}$,$R_{45}$,$R_{50}$,$R_{67}$=are independently A,G,U or absent;

$R_{40}$,$R_{53}$=are independently A,U or absent;

$R_{35}$=C or absent;

$R_{33}$,$R_{43}$=are independently C,G or absent;

$R_2$,$R_3$,$R_5$,$R_{16}$,$R_{32}$,$R_{34}$,$R_{59}$,$R_{65}$,$R_{72}$=are independently C,G,U or absent;

$R_{11}$,$R_{17}$,$R_{22}$,$R_{28}$,$R_{30}$,$R_{36}$,$R_{55}$,$R_{60}$,$R_{61}$,$R_{71}$=are independently C,U or absent;

$R_{10}$,$R_{19}$,$R_{20}$,$R_{38}$,$R_{52}$=are independently G or absent;

$R_8$,$R_{39}$,$R_{54}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{THR}$ (SEQ ID NO: 612), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Thr is:

$R_0$,$R_{18}$,$R_{23}$=absent $R_{14}$,$R_{40}$,$R_{41}$,$R_{57}$=are independently A or absent;

$R_{44}$=A,C or absent;

$R_9$,$R_{42}$,$R_{48}$,$R_{56}$=are independently A,C,G or absent;

$R_4$,$R_6$,$R_{12}$,$R_{26}$,$R_{58}$,$R_{64}$,$R_{66}$,$R_{68}$=are independently N or absent;

$R_{13}$, $R_{21}$,$R_{31}$,$R_{37}$,$R_{49}$,$R_{62}$=are independently A,C,U or absent;

$R_1$,$R_{15}$,$R_{24}$,$R_{27}$,$R_{29}$,$R_{46}$,$R_{51}$,$R_{69}$=are independently A,G or absent;

$R_7$,$R_{25}$,$R_{45}$,$R_{50}$,$R_{63}$,$R_{67}$=are independently A,G,U or absent;

$R_{53}$=A,U or absent;

$R_{35}$=C or absent;

$R_2$,$R_{33}$,$R_{43}$,$R_{70}$=are independently C,G or absent;

$R_8$,$R_{16}$,$R_{34}$,$R_{59}$,$R_{65}$=are independently C,G,U or absent;

$R_3$,$R_{11}$,$R_{22}$,$R_{28}$,$R_{30}$,$R_{36}$,$R_{55}$,$R_{60}$,$R_{61}$,$R_{71}$=are independently C,U or absent;

$R_{10}$,$R_{19}$,$R_{20}$,$R_{38}$,$R_{52}$=are independently G or absent;

$R_{32}$=G,U or absent;

$R_8$,$R_{17}$,$R_{39}$,$R_{54}$,$R_{72}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Tryptophan TREM Consensus Sequence

In an embodiment, a TREM disclosed herein comprises the sequence of Formula I$_{TRP}$ (SEQ ID NO: 613), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-[$R_{47}$]$_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Trp is:

$R_0$=absent;

$R_{24}$,$R_{39}$,$R_{41}$,$R_{57}$=are independently A or absent;

$R_2$,$R_3$,$R_{26}$,$R_{27}$,$R_{40}$,$R_{48}$=are independently A,C,G or absent;

$R_4$,$R_5$,$R_6$,$R_{29}$,$R_{30}$,$R_{31}$,$R_{32}$,$R_{34}$,$R_{42}$,$R_{44}$,$R_{45}$,$R_{46}$,$R_{49}$,$R_{51}$,$R_{58}$,$R_{63}$,$R_{66}$,$R_{67}$,$R_{68}$=are independently N or absent;

$R_{13}$,$R_{14}$,$R_{16}$,$R_{18}$,$R_{21}$,$R_{61}$,$R_{65}$,$R_{71}$=are independently A,C,U or absent;

$R_1$,$R_9$,$R_{10}$,$R_{15}$,$R_{33}$,$R_{50}$,$R_{56}$=are independently A,G or absent;

$R_7$,$R_{25}$,$R_{72}$=are independently A,G,U or absent;

$R_{37}$,$R_{38}$,$R_{55}$,$R_{60}$=are independently C or absent;

$R_{12}$,$R_{35}$,$R_{43}$,$R_{64}$,$R_{69}$,$R_{70}$=are independently C,G,U or absent;

$R_{11}$,$R_{17}$,$R_{22}$,$R_{28}$,$R_{59}$,$R_{62}$=are independently C,U or absent;

$R_{19}$,$R_{20}$,$R_{52}$=are independently G or absent;

$R_8$,$R_{23}$,$R_{36}$,$R_{53}$,$R_{54}$=are independently U or absent;

[$R_{47}$]$_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $II_{TRP}$ (SEQ ID NO: 614), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Trp is:

$R_0$,$R_{18}$, $R_{22}$,$R_{23}$-absent $R_{14}$,$R_{24}$,$R_{39}$,$R_{41}$,$R_{57}$,$R_{72}$=are independently A or absent;

$R_3$,$R_4$,$R_{13}$,$R_{61}$,$R_{71}$=are independently A,C or absent;

$R_6$,$R_{44}$=are independently A,C,G or absent;

$R_{21}$=A,C,U or absent;

$R_2$,$R_7$,$R_{15}$,$R_{25}$,$R_{33}$,$R_{34}$,$R_{45}$,$R_{56}$,$R_{63}$=are independently A,G or absent;

$R_{58}$=A,G,U or absent;

$R_{46}$=A,U or absent;

$R_{37}$,$R_{38}$,$R_{55}$,$R_{60}$,$R_{62}$=are independently C or absent;

$R_{12}$,$R_{26}$,$R_{27}$,$R_{35}$,$R_{40}$,$R_{48}$,$R_{67}$=are independently C,G or absent;

$R_{32}$,$R_{43}$,$R_{68}$=are independently C,G,U or absent;

$R_{11}$,$R_{16}$,$R_{28}$,$R_{31}$,$R_{49}$,$R_{59}$,$R_{65}$,$R_0$=are independently C,U or absent;

$R_1$,$R_9$,$R_{10}$,$R_{19}$,$R_{20}$,$R_{50}$,$R_{52}$,$R_{69}$=are independently G or absent;

$R_5$,$R_8$,$R_{29}$,$R_{30}$,$R_{42}$,$R_{51}$,$R_{64}$,$R_{66}$=are independently G,U or absent;

$R_{17}$, $R_{36}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $III_{TRP}$ (SEQ ID NO: 615), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-

$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Trp is:

$R_0$,$R_{18}$,$R_{22}$,$R_{23}$=absent $R_{14}$,$R_{24}$,$R_{39}$,$R_{41}$,$R_{57}$,$R_{72}$=are independently A or absent;

$R_3$,$R_4$,$R_{13}$,$R_{61}$,$R_{71}$=are independently A,C or absent;

$R_6$,$R_{44}$=are independently A,C,G or absent;

$R_{21}$=A,C,U or absent;

$R_2$,$R_7$,$R_{15}$,$R_{25}$,$R_{33}$,$R_{34}$,$R_{45}$,$R_{56}$,$R_{63}$=are independently A,G or absent;

$R_{58}$=A,G,U or absent;

$R_{46}$=A,U or absent;

$R_{37}$,$R_{38}$,$R_{55}$,$R_{60}$,$R_{62}$=are independently C or absent;

$R_{12}$,$R_{26}$,$R_{27}$,$R_{35}$,$R_{40}$,$R_{48}$,$R_{67}$=are independently C,G or absent;

$R_{32}$, $R_{43}$,$R_{68}$=are independently C,G,U or absent;

$R_{11}$,$R_{16}$,$R_{28}$,$R_{31}$,$R_{49}$,$R_{59}$,$R_{65}$,$R_{70}$=are independently C,U or absent;

$R_1$,$R_9$,$R_{10}$,$R_{19}$,$R_{20}$,$R_{50}$,$R_{52}$,$R_{69}$=are independently G or absent;

$R_5$,$R_8$,$R_{29}$,$R_{30}$,$R_{42}$,$R_{51}$,$R_{64}$,$R_{66}$=are independently G,U or absent;

$R_{17}$,$R_{36}$,$R_{53}$,$R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Tyrosine TREM Consensus sequence In an embodiment, a TREM disclosed herein comprises the sequence of Formula $I_{TYR}$ (SEQ ID NO: 616), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Tyr is:

$R_0$=absent $R_{14}$,$R_{39}$,$R_{57}$=are independently A or absent;

$R_{41}$,$R_{48}$,$R_{51}$,$R_{71}$=are independently A,C,G or absent;

$R_3$,$R_4$,$R_5$,$R_6$,$R_9$,$R_{10}$,$R_{12}$,$R_{13}$,$R_{16}$,$R_{25}$,$R_{26}$,$R_{30}$,$R_{31}$,$R_{32}$, $R_{42}$,$R_{44}$,$R_{45}$,$R_{46}$,$R_{49}$,$R_{50}$,$R_{58}$,$R_{62}$,$R_{63}$,$R_{66}$, $R_{67}$,$R_{68}$, $R_{69}$,$R_{70}$=are independently N or absent;

$R_{22}$, $R_{65}$=are independently A,C,U or absent;

$R_{15}$,$R_{24}$,$R_{27}$,$R_{33}$,$R_{37}$,$R_{40}$,$R_{56}$=are independently A,G or absent;

$R_7$,$R_{29}$,$R_{34}$,$R_{72}$=are independently A,G,U or absent;

$R_{23}$, $R_{53}$=are independently A,U or absent;

$R_{35}$,$R_{60}$=are independently C or absent;

$R_{20}$=C,G or absent;

$R_1,R_2,R_{28},R_{61},R_{64}$=are independently C,G,U or absent;

$R_1,R_{17},R_{21},R_{43},R_{55}$=are independently C,U or absent;

$R_{19},R_{52}$=are independently G or absent;

$R_8,R_{18},R_{36},R_{38},R_{54},R_{59}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $\text{II}_{TYR}$ (SEQ ID NO: 617), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Tyr is:

$R_0,R_{18},R_{23}$-absent $R_7,R_0,R_{14},R_{24},R_{26},R_{34},R_{39},R_{57}$=are independently A or absent;

$R_{44},R_{69}$=are independently A,C or absent;

$R_{71}$=A,C,G or absent;

$R_{68}$=N or absent;

$R_{58}$=A,C,U or absent;

$R_{33},R_{37},R_{41},R_{56},R_{62},R_{63}$=are independently A,G or absent;

$R_6,R_{29},R_{72}$=are independently A,G,U or absent;

$R_{31},R_{45},R_{53}$=are independently A,U or absent;

$R_{13},R_{35},R_{49},R_{60}$=are independently C or absent;

$R_{20},R_{48},R_{64},R_{67},R_{70}$=are independently C,G or absent;

$R_1,R_2,R_5,R_{16},R_{66}$=are independently C,G,U or absent;

$R_{11},R_{21},R_{28},R_{43},R_{55},R_{61}$=are independently C,U or absent;

$R_{10},R_{15},R_{19},R_{25},R_{27},R_{40},R_{51},R_{52}$=are independently G or absent;

$R_3,R_4,R_{30},R_{32},R_{42},R_{46}$=are independently G,U or absent;

$R_8, R_{12},R_{17},R_{22},R_{36},R_{38},R_{50},R_{54},R_{59},R_{65}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula $\text{III}_{TYR}$ (SEQ ID NO: 618), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Tyr is:

$R_0,R_{18}$, $R_{23}$-absent $R_7,R_0,R_{14},R_{24},R_{26},R_{34},R_{39},R_{57},R_{72}$=are independently A or absent;

$R_{44},R_{69}$=are independently A,C or absent;

$R_{71}$=A,C,G or absent;

$R_{37},R_{41},R_{56},R_{62},R_{63}$=are independently A,G or absent;

$R_6,R_{29},R_{68}$=are independently A,G,U or absent;

$R_{31},R_{45},R_{55}$=are independently A,U or absent;

$R_{13},R_{28},R_{35},R_{49},R_{60},R_{61}$=are independently C or absent;

$R_5,R_{48},R_{64},R_{67},R_{70}$=are independently C,G or absent;

$R_1,R_2$=are independently C,G,U or absent;

$R_{11},R_{16},R_{21},R_{43},R_{55},R_{66}$=are independently C,U or absent;

$R_{10},R_{15},R_{19},R_{20},R_{25},R_{27},R_{33},R_{40},R_{51},R_{52}$==are independently G or absent;

$R_3,R_4,R_{30},R_{32},R_{42},R_{46}$=are independently G,U or absent;

$R_8,R_{12},R_{17},R_{22},R_{36},R_{38},R_{50},R_{53},R_{54},R_{59},R_{65}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Valine TREM Consensus Sequence

In an embodiment, a TREM disclosed herein comprises the sequence of Formula $\text{I}_{VAL}$ (SEQ ID NO: 619), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Val is:

$R_0,R_{23}$-absent;

$R_{24}$, $R_{38},R_{57}$=are independently A or absent;

$R_0,R_{72}$=are independently A,C,G or absent;

$R_2,R_4,R_5,R_6,R_7,R_{12},R_{15},R_{16},R_{21},R_{25},R_{26},R_{29},R_{31},R_{32},R_{33},R_{34},R_{37},R_{41},R_{42},R_{43},R_{44},R_{45},R_{46},R_{48},R_{49},R_{50},$ $R_{58}, R_{61}, R_{62}, R_{63}, R_{64}, R_{65}, R_{66}, R_{67}, R_{68}, R_{69}, R_0$=are independently N or absent;

$R_{17}, R_{35}, R_{59}$=are independently A,C,U or absent;

$R_{10}, R_{14}, R_{27}, R_{40}, R_{52}, R_{56}$=are independently A,G or absent;

$R_1, R_3, R_{51}, R_{53}$=are independently A,G,U or absent;

$R_{39}$=C or absent;

$R_{13}, R_{30}, R_{55}$=are independently C,G,U or absent;

$R_{11}, R_{22}, R_{28}, R_{60}, R_{71}$=are independently C,U or absent;

$R_{19}$=G or absent;

$R_{20}$=G,U or absent;

$R_8, R_{18}, R_{36}, R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula II VAL (SEQ ID NO: 620), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Val is:

$R_0, R_{18}, R_{23}$=absent;

$R_{24}, R_{38}, R_{57}$=are independently A or absent;

$R_{64}, R_{70}, R_{72}$=are independently A,C,G or absent;

$R_{15}, R_{16}, R_{26}, R_{29}, R_{31}, R_{32}, R_{43}, R_{44}, R_{45}, R_{49}, R_{50}, R_{58}, R_{62}, R_{65}$=are independently N or absent;

$R_6, R_{17}, R_{34}, R_{37}, R_{41}, R_{59}$=are independently A,C,U or absent;

$R_0, R_{10}, R_{14}, R_{27}, R_{40}, R_{46}, R_{51}, R_{52}, R_{56}$=are independently A,G or absent;

$R_7, R_{12}, R_{25}, R_{33}, R_{53}, R_{63}, R_{66}, R_{65}$=are independently A,G,U or absent;

$R_{69}$=A,U or absent;

$R_{39}$=C or absent;

$R_5, R_{67}$=are independently C,G or absent;

$R_2, R_4, R_{13}, R_{48}, R_{55}, R_{61}$=are independently C,G,U or absent;

$R_{11}, R_{22}, R_{28}, R_{30}, R_{35}, R_{60}, R_{71}$=are independently C,U or absent;

$R_{19}$=G or absent;

$R_1, R_3, R_{20}, R_{42}$=are independently G,U or absent;

$R_8, R_{21}, R_{36}, R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13, x=1-

12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

In an embodiment, a TREM disclosed herein comprises the sequence of Formula III$_{VAL}$ (SEQ ID NO: 621), $R_0$-$R_1$-$R_2$-$R_3$-$R_4$-$R_5$-$R_6$-$R_7$-$R_8$-$R_9$-$R_{10}$-$R_{11}$-$R_{12}$-$R_{13}$-$R_{14}$-$R_{15}$-$R_{16}$-$R_{17}$-$R_{18}$-$R_{19}$-$R_{20}$-$R_{21}$-$R_{22}$-$R_{23}$-$R_{24}$-$R_{25}$-$R_{26}$-$R_{27}$-$R_{28}$-$R_{29}$-$R_{30}$-$R_{31}$-$R_{32}$-$R_{33}$-$R_{34}$-$R_{35}$-$R_{36}$-$R_{37}$-$R_{38}$-$R_{39}$-$R_{40}$-$R_{41}$-$R_{42}$-$R_{43}$-$R_{44}$-$R_{45}$-$R_{46}$-$[R_{47}]_x$-$R_{48}$-$R_{49}$-$R_{50}$-$R_{51}$-$R_{52}$-$R_{53}$-$R_{54}$-$R_{55}$-$R_{56}$-$R_{57}$-$R_{58}$-$R_{59}$-$R_{60}$-$R_{61}$-$R_{62}$-$R_{63}$-$R_{64}$-$R_{65}$-$R_{66}$-$R_{67}$-$R_{68}$-$R_{69}$-$R_{70}$-$R_{71}$-$R_{72}$ wherein R is a ribonucleotide residue and the consensus for Val is:

$R_0, R_{18}, R_{23}$-absent $R_{24}, R_{38}, R_{40}, R_{57}, R_{72}$=are independently A or absent;

$R_{29}, R_{64}, R_0$=are independently A,C,G or absent;

$R_{49}, R_{50}, R_{62}$=are independently N or absent;

$R_{16}, R_{26}, R_{31}, R_{32}, R_{37}, R_{41}, R_{43}, R_{59}, R_{65}$=are independently A,C,U or absent;

$R_0, R_{14}, R_{27}, R_{46}, R_{52}, R_{56}, R_{66}$=are independently A,G or absent;

$R_7, R_{12}, R_{25}, R_{33}, R_{44}, R_{45}, R_{53}, R_{58}, R_{63}, R_{68}$=are independently A,G,U or absent;

$R_{69}$=A,U or absent;

$R_{39}$=C or absent;

$R_5, R_{67}$=are independently C,G or absent;

$R_2, R_4, R_{13}, R_{15}, R_{48}, R_{55}$=are independently C,G,U or absent;

$R_6, R_{11}, R_{22}, R_{28}, R_{30}, R_{34}, R_{35}, R_{60}, R_{61}, R_{71}$=are independently C,U or absent;

$R_{10}, R_{19}, R_{51}$=are independently G or absent;

$R_1, R_3, R_{20}, R_{42}$=are independently G,U or absent;

$R_8, R_{17}, R_{21}, R_{36}, R_{54}$=are independently U or absent;

$[R_{47}]_x$=N or absent;

wherein, e.g., x=1-271 (e.g., x=1-250, x=1-225, x=1-200, x=1-175, x=1-150, x=1-125, x=1-100, x=1-75, x=1-50, x=1-40, x=1-30, x=1-29, x=1-28, x=1-27, x=1-26, x=1-25, x=1-24, x=1-23, x=1-22, x=1-21, x=1-20, x=1-19, x=1-18, x=1-17, x=1-16, x=1-15, x=1-14, x=1-13; x=1-12, x=1-11, x=1-10, x=10-271, x=20-271, x=30-271, x=40-271, x=50-271, x=60-271, x=70-271, x=80-271, x=100-271, x=125-271, x=150-271, x=175-271, x=200-271, x=225-271, x=1, x=2, x=3, x=4, x=5, x=6, x=7, x=8, x=9, x=10, x=11, x=12, x=13, x=14, x=15, x=16, x=17, x=18, x=19, x=20, x=21, x=22, x=23, x=24, x=25, x=26, x=27, x=28, x=29, x=30, x=40, x=50, x=60, x=70, x=80, x=90, x=100, x=110, x=125, x=150, x=175, x=200, x=225, x=250, or x=271), provided that the TREM has one or both of the following properties: no more than 15% of the residues are N; or no more than 20 residues are absent.

Variable Region Consensus Sequence

In an embodiment, a TREM disclosed herein comprises a variable region at position $R_{47}$. In an embodiment, the variable region is 1-271 ribonucleotides in length (e.g. 1-250, 1-225, 1-200, 1-175, 1-150, 1-125, 1-100, 1-75, 1-50, 1-40, 1-30, 1-29, 1-28, 1-27, 1-26, 1-25, 1-24, 1-23, 1-22, 1-21, 1-20, 1-19, 1-18, 1-17, 1-16, 1-15, 1-14, 1-13, 1-12, 1-11, 1-10, 10-271, 20-271, 30-271, 40-271, 50-271, 60-271, 70-271, 80-271, 100-271, 125-271, 150-271, 175-271, 200-271, 225-271, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 50, 60, 70, 80, 90, 100, 110, 125, 150, 175, 200, 225, 250, or 271 ribonucleotides). In an embodiment, the variable region comprises any one, all or a combination of Adenine, Cytosine, Guanine or Uracil.

In an embodiment, the variable region comprises a ribo-nucleic acid (RNA) sequence encoded by a deoxyribo-nucleic acid (DNA) sequence disclosed in Table 4, e.g., any one of SEQ ID NOs: 452-561 disclosed in Table 4.

TABLE 4

Exemplary variable region sequences.

| | SEQ ID NO | SEQUENCE |
|---|---|---|
| 1 | 452 | AAAATATAAATATATTTC |
| 2 | 453 | AAGCT |
| 3 | 454 | AAGTT |
| 4 | 455 | AATTCTTCGGAATGT |
| 5 | 456 | AGA |
| 6 | 457 | AGTCC |
| 7 | 458 | CAACC |
| 8 | 459 | CAATC |
| 9 | 460 | CAGC |
| 10 | 461 | CAGGCGGGTTCTGCCCGCGC |
| 11 | 462 | CATACCTGCAAGGGTATC |
| 12 | 463 | CGACCGCAAGGTTGT |
| 13 | 464 | CGACCTTGCGGTCAT |
| 14 | 465 | CGATGCTAATCACATCGT |
| 15 | 466 | CGATGGTGACATCAT |
| 16 | 467 | CGATGGTTACATCGT |
| 17 | 468 | CGCCGTAAGGTGT |
| 18 | 469 | CGCCTTAGGTGT |
| 19 | 470 | CGCCTTTCGACGCGT |
| 20 | 471 | CGCTTCACGGCGT |
| 21 | 472 | CGGCAGCAATGCTGT |
| 22 | 473 | CGGCTCCGCCTTC |
| 23 | 474 | CGGGTATCACAGGGTC |
| 24 | 475 | CGGTGCGCAAGCGCTGT |
| 25 | 476 | CGTACGGGTGACCGTACC |
| 26 | 477 | CGTCAAAGACTTC |
| 27 | 478 | CGTCGTAAGACTT |
| 28 | 479 | CGTTGAATAAACGT |
| 29 | 480 | CTGTC |
| 30 | 481 | GGCC |

TABLE 4-continued

Exemplary variable region sequences.

| | SEQ ID NO | SEQUENCE |
|---|---|---|
| 31 | 482 | GGGGATT |
| 32 | 483 | GGTC |
| 33 | 484 | GGTTT |
| 34 | 485 | GTAG |
| 35 | 486 | TAACTAGATACTTTCAGAT |
| 36 | 487 | TACTCGTATGGGTGC |
| 37 | 488 | TACTTTGCGGTGT |
| 38 | 489 | TAGGCGAGTAACATCGTGC |
| 39 | 490 | TAGGCGTGAATAGCGCCTC |
| 40 | 491 | TAGGTCGCGAGAGCGGCGC |
| 41 | 492 | TAGGTCGCGTAAGCGGCGC |
| 42 | 493 | TAGGTGGTTATCCACGC |
| 43 | 494 | TAGTC |
| 44 | 495 | TAGTT |
| 45 | 496 | TATACGTGAAAGCGTATC |
| 46 | 497 | TATAGGGTCAAAAACTCTATC |
| 47 | 498 | TATGCAGAAATACCTGCATC |
| 48 | 499 | TCCCCATACGGGGGC |
| 49 | 500 | TCCCGAAGGGGTTC |
| 50 | 501 | TCTACGTATGTGGGC |
| 51 | 502 | TCTCATAGGAGTTC |
| 52 | 503 | TCTCCTCTGGAGGC |
| 53 | 504 | TCTTAGCAATAAGGT |
| 54 | 505 | TCTTGTAGGAGTTC |
| 55 | 506 | TGAACGTAAGTTCGC |
| 56 | 507 | TGAACTGCGAGGTTCC |
| 57 | 508 | TGAC |
| 58 | 509 | TGACCGAAAGGTCGT |
| 59 | 510 | TGACCGCAAGGTCGT |
| 60 | 511 | TGAGCTCTGCTCTC |
| 61 | 512 | TGAGGCCTCACGGCCTAC |
| 62 | 513 | TGAGGGCAACTTCGT |
| 63 | 514 | TGAGGGTCATACCTCC |
| 64 | 515 | TGAGGGTGCAAATCCTCC |
| 65 | 516 | TGCCGAAAGGCGT |
| 66 | 517 | TGCCGTAAGGCGT |
| 67 | 518 | TGCGGTCTCCGCGC |
| 68 | 519 | TGCTAGAGCAT |

TABLE 4-continued

Exemplary variable region sequences.

| SEQ ID NO | SEQUENCE |
|---|---|
| 69 | 520 | TGCTCGTATAGAGCTC |
| 70 | 521 | TGGACAATTGTCTGC |
| 71 | 522 | TGGACAGATGTCCGT |
| 72 | 523 | TGGACAGGTGTCCGC |
| 73 | 524 | TGGACGGTTGTCCGC |
| 74 | 525 | TGGACTTGTGGTC |
| 75 | 526 | TGGAGATTCTCTCCGC |
| 76 | 527 | TGGCATAGGCCTGC |
| 77 | 528 | TGGCTTATGTCTAC |
| 78 | 529 | TGGGAGTTAATCCCGT |
| 79 | 530 | TGGGATCTTCCCGC |
| 80 | 531 | TGGGCAGAAATGTCTC |
| 81 | 532 | TGGGCGTTCGCCCGC |
| 82 | 533 | TGGGCTTCGCCCGC |
| 83 | 534 | TGGGGGATAACCCCGT |
| 84 | 535 | TGGGGGTTTCCCCGT |
| 85 | 536 | TGGT |
| 86 | 537 | TGGTGGCAACACCGT |
| 87 | 538 | TGGTTTATAGCCGT |
| 88 | 539 | TGTACGGTAATACCGTACC |
| 89 | 540 | TGTCCGCAAGGACGT |
| 90 | 541 | TGTCCTAACGGACGT |
| 91 | 542 | TGTCCTATTAACGGACGT |
| 92 | 543 | TGTCCTTCACGGGCGT |
| 93 | 544 | TGTCTTAGGACGT |
| 94 | 545 | TGTGCGTTAACGCGTACC |
| 95 | 546 | TGTGTCGCAAGGCACC |
| 96 | 547 | TGTTCGTAAGGACTT |
| 97 | 548 | TTCACAGAAATGTGTC |
| 98 | 549 | TTCCCTCGTGGAGT |
| 99 | 550 | TTCCCTCTGGGAGC |
| 100 | 551 | TTCCCTTGTGGATC |
| 101 | 552 | TTCCTTCGGGAGC |
| 102 | 553 | TTCTAGCAATAGAGT |
| 103 | 554 | TTCTCCACTGGGGAGC |
| 104 | 555 | TTCTCGAGAGGGAGC |
| 105 | 556 | TTCTCGTATGAGAGC |
| 106 | 557 | TTTAAGGTTTTCCCTTAAC |

TABLE 4-continued

Exemplary variable region sequences.

| SEQ ID NO | SEQUENCE |
|---|---|
| 107 | 558 | TTTCATTGTGGAGT |
| 108 | 559 | TTTCGAAGGAATCC |
| 109 | 560 | TTTCTTCGGAAGC |
| 110 | 561 | TTTGGGGCAACTCAAC |

Corresponding Nucleotide Positions

To determine if a selected nucleotide position in a candidate sequence corresponds to a selected position in a reference sequence (e.g., SEQ ID NO: 622, SEQ ID NO: 993, SEQ ID NO: 1079), one or more of the following Evaluations is performed.

Evaluation A:

1. The candidate sequence is aligned with each of the consensus sequences in Tables 9 and 10. The consensus sequence(s) having the most positions aligned (and which has at least 60% of the positions of the candidate sequence aligned) is selected.

The alignment is performed as is follows. The candidate sequence and an isodecoder consensus sequence from Tables 10A-10B are aligned based on a global pairwise alignment calculated with the Needleman-Wunsch algorithm when run with match scores from Table 11, a mismatch penalty of −1, a gap opening penalty of −1, and a gap extension penalty of −0.5, and no penalty for end gaps. The alignment with the highest overall alignment score is then used to determine the percent similarity between the candidate and the consensus sequence by counting the number of matched positions in the alignment, dividing it by the larger of the number of non-N bases in the candidate sequence or the consensus sequence, and multiplying the result by 100. In cases where multiple alignments (of the candidate and a single consensus sequence) tie for the same score, the percent similarity is the largest percent similarity calculated from the tied alignments. This process is repeated for the candidate sequence with each of the remaining isodecoder consensus sequences in Tables 10A-10B, and the alignment resulting in the greatest percent similarity is selected. If this alignment has a percent similarity equal to or greater than 60%, it is considered a valid alignment and used to relate positions in the candidate sequence to those in the consensus sequence, otherwise the candidate sequence is considered to have not aligned to any of the isodecoder consensus sequences. If there is a tie at this point, all tied consensus sequences are taken forward to step 2 in the analysis.

2. Using the selected consensus sequence(s) from step 1, one determines the consensus sequence position number that aligns with the selected position (e.g., a modified position) in the candidate sequence. One then assigns the position number of the aligned position in the consensus sequence to the selected position in the candidate sequence, in other words, the selected position in the candidate sequence is numbered according to the numbering of the consensus sequence. If there were tied consensus sequences from step one, and they give different position numbers in this step 2, then all such position numbers are taken forward to step 5.

3. The reference sequence is aligned with the consensus sequence chosen in step 1. The alignment is performed as described in step 1.

4. From the alignment in step 3, one determines the consensus sequence position number that aligns with the selected position (e.g., a modified position) in the reference sequence. One then assigns the position number of the aligned position in the consensus sequence to the selected position in the reference sequence, in other words, the selected position in the reference sequence is numbered according to the numbering of the consensus sequence. If there is a tie at this point, all tied consensus sequences are taken forward to step 5 in the analysis.

5. If a value for a position number determined for the reference sequence in step 2 is the same as the value for the position number determined for the candidate sequence in step 4, the positions are defined as corresponding.

Evaluation B:

The reference sequence (e.g., a TREM sequence described herein) and the candidate sequence are aligned with one another. The alignment is performed as follows.

The reference sequence and the candidate sequence are aligned based on a global pairwise alignment calculated with the Needleman-Wunsch algorithm when run with match scores from Table 11, a mismatch penalty of −1, a gap opening penalty of −1, and a gap extension penalty of −0.5, and no penalty for end gaps. The alignment with the highest overall alignment score is then used to determine the percent similarity between the candidate and reference sequence by counting the number of matched based in the alignment, dividing it by the larger of the number of non-N bases in the candidate or reference sequence, and multiplying the result by 100. In cases where multiple alignments tie for the same score, the percent similarity is the largest percent similarity calculated from the tied alignments. If this alignment has a percent similarity equal to or greater than 60%, it is considered a valid alignment and used to relate positions in the candidate sequence to those in the reference sequence, otherwise the candidate sequence is considered to have not aligned to the reference sequence.

If the selected nucleotide position in the reference sequence (e.g., a modified position) is paired with a selected nucleotide position (e.g., a modified position) in the candidate sequence, the positions are defined as corresponding.

If the selected position in the reference sequence and the candidate sequence are found to be corresponding in at least one of Evaluations A and B, the positions correspond. Thus, e.g., if two positions are found to be corresponding under Evaluation A, but do not correspond under Evaluation B, the positions are defined as corresponding.

The numbering given above is used for ease of presentation and does not imply a required sequence. If more than one Evaluation is performed, they can be performed in any order

TABLE 10A

| Consensus sequence computationally generated for each isodecoder by aligning members of the isodecoder family | | | |
| --- | --- | --- | --- |
| SEQ ID NO. | Amino Acid | Anticodon | Consensus sequence |
| 1200 | Ala | AGC | GGGGAATTAGCTCAAGTGGTAGAGCGCTTG CTTAGCATGCAAGAGGTAGTGGGATCGATG CCCACATTCTCCA |
| 1201 | Ala | CGC | GGGGATGTAGCTCAGTGGTAGAGCGCATGC TTCGCATGTATGAGGTCCCGGGTTCGATCCC CGGCATCTCCA |
| 1202 | Ala | TGC | GGGGGTGTAGCTCAGTGGTAGAGCGCATGC TTTGCATGTATGAGGCCCCGGGTTCGATCCC CGGCACCTCCA |
| 1203 | Arg | ACG | GGGCCAGTGGCGCAATGGATAACGCGTCTG ACTACGGATCAGAAGATTCCAGGTTCGACTC CTGGCTGGCTCG |
| 1204 | Arg | CCG | GGCCGCGTGGCCTAATGGATAAGGCGTCTG ATTCCGGATCAGAAGATTGAGGGTTCGAGTC CCTTCGTGGTCG |
| 1205 | Arg | CCT | GCCCCAGTGGCCTAATGGATAAGGCACTGG CCTCCTAAGCCAGGGATTGTGGGTTCGAGTC CCACCTGGGGTA |
| 1206 | Arg | TCG | GACCGCGTGGCCTAATGGATAAGGCGTCTG ACTTCGGATCAGAAGATTGAGGGTTCGAGTC CCTCCGTGGTCG |
| 1207 | Arg | TCT | GGCTCTGTGGCGCAATGGATNAGCGCATTG GACTTCTAATTCAAAGGTTGCGGGTTCGAGT CCCNCCAGAGTCG |
| 1208 | Asn | GTT | GTCTCTGTGGCGCAATCGGTTAGCGCGTTCG GCTGTTAACCGNAAAGGTTGGTGGTTCGAGC CCACCCAGGGACG |
| 1209 | Asp | GTC | TCCTCGTTAGTATAGTGGTGAGTATCCCCGC CTGTCACGCGGGAGACCGGGGTTCGATTCCC CGACGGGGAG |

TABLE 10A-continued

Consensus sequence computationally generated for each
isodecoder by aligning members of the isodecoder family

| SEQ ID NO. | Amino Acid | Anticodon | Consensus sequence |
|---|---|---|---|
| 1210 | Cys | GCA | GGGGGTATAGCTCAGNGGGTAGAGCATTTG<br>ACTGCAGATCAAGAGGTCCCCGGTTCAAATC<br>CGGGTGCCCCCT |
| 1211 | Gln | CTG | GGTTCCATGGTGTAATGGTNAGCACTCTGGA<br>CTCTGAATCCAGCGATCCGAGTTCAAGTCTC<br>GGTGGAACCT |
| 1212 | Gln | TTG | GGTCCCATGGTGTAATGGTTAGCACTCTGGA<br>CTTTGAATCCAGCGATCCGAGTTCAAATCTC<br>GGTGGGACCT |
| 1213 | Glu | CTC | TCCCTGGTGGTCTAGTGGTTAGGATTCGGCG<br>CTCTCACCGCCGCGGCCCGGGTTCGATTCCC<br>GGTCAGGGAA |
| 1214 | Glu | TTC | TCCCTGGTGGTCTAGTGGCTAGGATTCGGCG<br>CTTTCACCGCNGCGGCCCGGGTTCGATTCCC<br>GGTCAGGGAA |
| 1215 | Gly | CCC | GCATTGGTGGTTCAGTGGTAGAATTCTCGCC<br>TCCCACGCNGGAGACCCGGGTTCGATTCCCG<br>GCCAATGCA |
| 1216 | Gly | GCC | GCATTGGTGGTTCAGTGGTAGAATTCTCGCC<br>TGCCACGCGGGAGGCCCGGGTTCGATTCCCG<br>GCCAATGCA |
| 1217 | Gly | TCC | GCGTTGGTGGTATAGTGGTGAGCATAGCTGC<br>CTTCCAAGCAGTTGACCCGGGTTCGATTCCC<br>GGCCAACGCA |
| 1218 | Ile | AAT | GGCCGGTTAGCTCAGTTGGTTAGAGCGTGGT<br>GCTAATAACGCCAAGGTCGCGGGTTCGATCC<br>CCGTACGGGCCA |
| 1219 | Ile | TAT | GCTCCAGTGGCGCAATCGGTTAGCGCGCGGT<br>ACTTATAATGCCGAGGTTGTGAGTTCGAGCC<br>TCACCTGGAGCA |
| 1220 | Leu | AAG | GGTAGCGTGGCCGAGCGGTCTAAGGCGCTG<br>GATTAAGGCTCCAGTCTCTTCGGGGGCGTGG<br>GTTCGAATCCCACCGCTGCCA |
| 1221 | Leu | CAA | GTCAGGATGGCCGAGTGGTCNTAAGGCGCC<br>AGACTCAAGTTCTGGTCTCCGNATGGAGGCG<br>TGGGTTCGAATCCCACTTCTGACA |
| 1222 | Leu | CAG | GTCAGGATGGCCGAGCGGTCTAAGGCGCTG<br>CGTTCAGGTCGCAGTCTCCCCTGGAGGCGTG<br>GGTTCGAATCCCACTCCTGACA |
| 1223 | Leu | TAA | ACCAGGATGGCCGAGTGGTTAAGGCGTTGG<br>ACTTAAGATCCAATGGACAGATGTCCGCGTG<br>GGTTCGAACCCCACTCCTGGTA |
| 1224 | Leu | TAG | GGTAGCGTGGCCGAGCGGTCTAAGGCGCTG<br>GATTTAGGCTCCAGTCTCTTCGGNGGCGTGG<br>GTTCGAATCCCACCGCTGCCA |
| 1225 | Lys | CTT | GCCCGGCTAGCTCAGTCGGTAGAGCATGAG<br>ACTCTTAATCTCAGGGTCGTGGGTTCGAGCC<br>CCACGTTGGGCGNNN |
| 1226 | Lys | TTT | GCCTGGATAGCTCAGTCGGTAGAGCATCAG<br>ACTTTTAATCTGAGGGTCCAGGGTTCAAGTC<br>CCTGTTCAGGCG |
| 1227 | Met | CAT | GCCCTCTTAGCGCAGTNGGCAGCGCGTCAGT<br>CTCATAATCTGAAGGTCCTGAGTTCGAGCCT<br>CAGAGAGGGCA |
| 1228 | Phe | GAA | GCCGAAATAGCTCAGTTGGGAGAGCGTTAG<br>ACTGAAGATCNTAAAGGTCCCTGGTTCAATC<br>CCGGGTTTCGGCA |

TABLE 10A-continued

Consensus sequence computationally generated for each
isodecoder by aligning members of the isodecoder family SEQ ID NO. Amino Acid Anticodon Consensus sequence

| 1229 | Pro | AGG | GGCTCGTTGGTCTAGGGGTATGATTCTCGCT<br>TAGGATGCGAGAGGTCCCGGGTTCAAATCC<br>CGGACGAGCCC |
|---|---|---|---|
| 1230 | Pro | CGG | GGCTCGTTGGTCTAGGGGTATGATTCTCGCT<br>TCGGGTGCGAGAGGTCCCGGGTTCAAATCCC<br>GGACGAGCCC |
| 1231 | Pro | TGG | GGCTCGTTGGTCTAGGGGTATGATTCTCGCT<br>TTGGGTGCGAGAGGTCCCGGGTTCAAATCCC<br>GGACGAGCCC |
| 1232 | Ser | AGA | GTAGTCGTGGCCGAGTGGTTAAGGCGATGG<br>ACTAGAAATCCATTGGGGTTTCCCCGCGCAG<br>GTTCGAATCCTGCCGACTACG |
| 1233 | Ser | CGA | GCTGTGATGGCCGAGTGGTTAAGGCGTTGG<br>ACTCGAAATCCAATGGGGTCTCCCCGCGCAG<br>GTTCGAATCCTGCTCACAGCG |
| 1234 | Ser | GCT | GACGAGGNNTGGCCGAGTGGTTAAGGCGAT<br>GGACTGCTAATCCATTGTGCTCTGCACGCGT<br>GGGTTCGAATCCCATCCTCGTCG |
| 1235 | Ser | TGA | GTAGTCGTGGCCGAGTGGTTAAGGCGATGG<br>ACTTGAAATCCATTGGGGTCTCCCCGCGCAG<br>GTTCGAATCCTGCCGGCTACG |
| 1236 | Thr | AGT | GGCTCCGTGGCTTAGCTGGTTAAAGCGCCTG<br>TCTAGTAAACAGGAGATCCTGGGTTCGAATC<br>CCAGCGGGGCCT |
| 1237 | Thr | CGT | GGCNCTGTGGCTNAGTNGGNTAAAGCGCCG<br>GTCTCGTAAACCNGGAGATCNTGGGTTCGA<br>ATCCCANCNGGGCCT |
| 1238 | Thr | TGT | GGCTCCATAGCTCAGNGGGTTAGAGCACTG<br>GTCTTGTAAACCAGGGGTCGCGAGTTCAAAT<br>CTCGCTGGGGCCT |
| 1239 | Trp | CCA | GACCTCGTGGCGCAACGGTAGCGCGTCTGA<br>CTCCAGATCAGAAGGTTGCGTGTTCAAATCA<br>CGTCGGGGTCA |
| 1240 | Tyr | GTA | CCTTCGATAGCTCAGCTGGTAGAGCGGAGG<br>ACTGTAGATCCTTAGGTCGCTGGTTCGATTC<br>CGGCTCGAAGGA |
| 1241 | Val | AAC | GTTTCCGTAGTGTAGTGGTTATCACGTTCGC<br>CTAACACGCGAAAGGTCCCCGGTTCGAAAC<br>CGGGCGGAAACA |
| 1242 | Val | CAC | GTTTCCGTAGTGTAGTGGTTATCACGTTCGC<br>CTCACACGCGAAAGGTCCCCGGTTCGAAAC<br>CGGGCGGAAACA |
| 1243 | Val | TAC | GGTTCCATAGTGTAGTGGTTATCACGTCTGC<br>TTTACACGCAGAAGGTCCTGGGTTCGAGCCC<br>CAGTGGAACCA |
| 1244 | iMet | CAT | AGCAGAGTGGCGCAGCGGAAGCGTGCTGGG<br>CCCATAACCCAGAGGTCGATGGATCGAAAC<br>CATCCTCTGCTA |

TABLE 10B

| SEQ ID NO | Amino Acid | Anticodon | Consensus sequence |
|---|---|---|---|
| | | | Consensus sequence computationally generated for each isodecoder by aligning members of the isodecoder family |
| 1245 | Ala | AGC | GGGGAATTAGCTCAAGTGGTAGAGCGCTTGC TTAGCATGCAAGAGGTAGTGGGATCGATGCC CACATTCTCCANNN |
| 1246 | Ala | CGC | GGGGATGTAGCTCAGTGGTAGAGCGCATGCT TCGCATGTATGAGGTCCCGGGTTCGATCCCC GGCATCTCCANNN |
| 1247 | Ala | TGC | GGGGGTGTAGCTCAGTGGTAGAGCGCATGCT TTGCATGTATGAGGCCCCGGGTTCGATCCCC GGCACCTCCANNN |
| 1248 | Arg | ACG | GGGCCAGTGGCGCAATGGATAACGCGTCTGA CTACGGATCAGAAGATTCCAGGTTCGACTCC TGGCTGGCTCGNNN |
| 1249 | Arg | CCG | GGCCGCGTGGCCTAATGGATAAGGCGTCTGA TTCCGGATCAGAAGATTGAGGGTTCGAGTCC CTTCGTGGTCGNNN |
| 1250 | Arg | CCT | GCCCCAGTGGCCTAATGGATAAGGCACTGGC CTCCTAAGCCAGGGATTGTGGGTTCGAGTCC CACCTGGGGTANNN |
| 1251 | Arg | TCG | GACCGCGTGGCCTAATGGATAAGGCGTCTGA CTTCGGATCAGAAGATTGAGGGTTCGAGTCC CTCCGTGGTCGNNN |
| 1252 | Arg | TCT | GGCTCTGTGGCGCAATGGATNAGCGCATTGG ACTTCTAATTCAAAGGTTGCGGGTTCGAGTC CCNCCAGAGTCGNNN |
| 1253 | Asn | GTT | GTCTCTGTGGCGCAATCGGTTAGCGCGTTCG GCTGTTAACCGNAAAGGTTGGTGGTTCGAGC CCACCCAGGGACGNNN |
| 1254 | Asp | GTC | TCCTCGTTAGTATAGTGGTGAGTATCCCCGCC TGTCACGCGGGAGACCGGGGTTCGATTCCCC GACGGGGAGNNN |
| 1255 | Cys | GCA | GGGGGTATAGCTCAGNGGGTAGAGCATTTGA CTGCAGATCAAGAGGTCCCCGGTTCAAATCC GGGTGCCCCCTNNN |
| 1256 | Gln | CTG | GGTTCCATGGTGTAATGGTNAGCACTCTGGA CTCTGAATCCAGCGATCCGAGTTCAAGTCTC GGTGGAACCTNNN |
| 1257 | Gln | TTG | GGTCCCATGGTGTAATGGTTAGCACTCTGGA CTTTGAATCCAGCGATCCGAGTTCAAATCTC GGTGGGACCTNNN |
| 1258 | Glu | CTC | TCCCTGGTGGTCTAGTGGTTAGGATTCGGCG CTCTCACCGCCGCGGCCCGGGTTCGATTCCC GGTCAGGGAANNN |
| 1259 | Glu | TTC | TCCCTGGTGGTCTAGTGGCTAGGATTCGGCG CTTTCACCGCNGCGGCCCGGGTTCGATTCCC GGTCAGGGAANNN |
| 1260 | Gly | CCC | GCATTGGTGGTTCAGTGGTAGAATTCTCGCCT CCCACGCNGGAGACCCGGGTTCGATTCCCGG CCAATGCANNN |
| 1261 | Gly | GCC | GCATTGGTGGTTCAGTGGTAGAATTCTCGCCT GCCACGCGGGAGGCCCGGGTTCGATTCCCGG CCAATGCANNN |
| 1262 | Gly | TCC | GCGTTGGTGGTATAGTGGTGAGCATAGCTGC CTTCCAAGCAGTTGACCCGGGTTCGATTCCC GGCCAACGCANNN |
| 1263 | Ile | AAT | GGCCGGTTAGCTCAGTTGGTTAGAGCGTGGT GCTAATAACGCCAAGGTCGCGGGTTCGATCC CCGTACGGGCCANNN |

TABLE 10B-continued

Consensus sequence computationally generated for each
isodecoder by aligning members of the isodecoder family

| SEQ ID NO | Amino Acid | Anticodon | Consensus sequence |
|---|---|---|---|
| 1264 | Ile | TAT | GCTCCAGTGGCGCAATCGGTTAGCGCGCGGT ACTTATAATGCCGAGGTTGTGAGTTCGAGCC TCACCTGGAGCANNN |
| 1265 | Leu | AAG | GGTAGCGTGGCCGAGCGGTCTAAGGCGCTGG ATTAAGGCTCCAGTCTCTTCGGGGGCGTGGG TTCGAATCCCACCGCTGCCANNN |
| 1266 | Leu | CAA | GTCAGGATGGCCGAGTGGTCNTAAGGCGCCA GACTCAAGTTCTGGTCTCCGNATGGAGGCGT GGGTTCGAATCCCACTTCTGACANNN |
| 1267 | Leu | CAG | GTCAGGATGGCCGAGCGGTCTAAGGCGCTGC GTTCAGGTCGCAGTCTCCCCTGGAGGCGTGG GTTCGAATCCCACTCCTGACANNN |
| 1268 | Leu | TAA | ACCAGGATGGCCGAGTGGTTAAGGCGTTGGA CTTAAGATCCAATGGACAGATGTCCGCGTGG GTTCGAACCCCACTCCTGGTANNN |
| 1269 | Leu | TAG | GGTAGCGTGGCCGAGCGGTCTAAGGCGCTGG ATTTAGGCTCCAGTCTCTTCGGNGGCGTGGG TTCGAATCCCACCGCTGCCANNN |
| 1270 | Lys | CTT | GCCCGGCTAGCTCAGTCGGTAGAGCATGAGA CTCTTAATCTCAGGGTCGTGGGTTCGAGCCCC ACGTTGGGCGNNNNNNN |
| 1271 | Lys | TTT | GCCTGGATAGCTCAGTCGGTAGAGCATCAGA CTTTTAATCTGAGGGTCCAGGGTTCAAGTCCC TGTTCAGGCGNNN |
| 1272 | Met | CAT | GCCCTCTTAGCGCAGTNGGCAGCGCGTCAGT CTCATAATCTGAAGGTCCTGAGTTCGAGCCT CAGAGAGGGCANNN |
| 1273 | Phe | GAA | GCCGAAATAGCTCAGTTGGGAGAGCGTTAGA CTGAAGATCNTAAAGGTCCCTGGTTCAATCC CGGGTTTCGGCANNN |
| 1274 | Pro | AGG | GGCTCGTTGGTCTAGGGGTATGATTCTCGCTT AGGATGCGAGAGGTCCCGGGTTCAAATCCCG GACGAGCCCNNN |
| 1275 | Pro | CGG | GGCTCGTTGGTCTAGGGGTATGATTCTCGCTT CGGGTGCGAGAGGTCCCGGGTTCAAATCCCG GACGAGCCCNNN |
| 1276 | Pro | TGG | GGCTCGTTGGTCTAGGGGTATGATTCTCGCTT TGGGTGCGAGAGGTCCCGGGTTCAAATCCCG GACGAGCCCNNN |
| 1277 | Ser | AGA | GTAGTCGTGGCCGAGTGGTTAAGGCGATGGA CTAGAAATCCATTGGGGTTTCCCCGCGCAGG TTCGAATCCTGCCGACTACGNNN |
| 1278 | Ser | CGA | GCTGTGATGGCCGAGTGGTTAAGGCGTTGGA CTCGAAATCCAATGGGGTCTCCCCGCGCAGG TTCGAATCCTGCTCACAGCGNNN |
| 1279 | Ser | GCT | GACGAGGNNTGGCCGAGTGGTTAAGGCGAT GGACTGCTAATCCATTGTGCTCTGCACGCGT GGGTTCGAATCCCATCCTCGTCGNNN |
| 1280 | Ser | TGA | GTAGTCGTGGCCGAGTGGTTAAGGCGATGGA CTTGAAATCCATTGGGGTCTCCCCGCGCAGG TTCGAATCCTGCCGGCTACGNNN |
| 1281 | Thr | AGT | GGCTCCGTGGCTTAGCTGGTTAAAGCGCCTG TCTAGTAAACAGGAGATCCTGGGTTCGAATC CCAGCGGGGCCTNNN |

TABLE 10B-continued

Consensus sequence computationally generated for each
isodecoder by aligning members of the isodecoder family

| SEQ ID NO | Amino Acid | Anticodon | Consensus sequence |
|---|---|---|---|
| 1282 | Thr | CGT | GGCNCTGTGGCTNAGTNGGNTAAAGCGCCGG TCTCGTAAACCNGGAGATCNTGGGTTCGAAT CCCANCNGGGCCTNNN |
| 1283 | Thr | TGT | GGCTCCATAGCTCAGNGGGTTAGAGCACTGG TCTTGTAAACCAGGGGTCGCGAGTTCAAATC TCGCTGGGGCCTNNN |
| 1284 | Trp | CCA | GACCTCGTGGCGCAACGGTAGCGCGTCTGAC TCCAGATCAGAAGGTTGCGTGTTCAAATCAC GTCGGGGTCANNN |
| 1285 | Tyr | GTA | CCTTCGATAGCTCAGCTGGTAGAGCGGAGGA CTGTAGATCCTTAGGTCGCTGGTTCGATTCCG GCTCGAAGGANNN |
| 1286 | Val | AAC | GTTTCCGTAGTGTAGTGGTTATCACGTTCGCC TAACACGCGAAAGGTCCCCGGTTCGAAACCG GGCGGAAACANNN |
| 1287 | Val | CAC | GTTTCCGTAGTGTAGTGGTTATCACGTTCGCC TCACACGCGAAAGGTCCCCGGTTCGAAACCG GGCGGAAACANNN |
| 1288 | Val | TAC | GGTTCCATAGTGTAGTGGTTATCACGTCTGCT TTACACGCAGAAGGTCCTGGGTTCGAGCCCC AGTGGAACCANNN |
| 1289 | iMet | CAT | AGCAGAGTGGCGCAGCGGAAGCGTGCTGGG CCCATAACCCAGAGGTCGATGGATCGAAACC ATCCTCTGCTANNN |

TABLE 11

Score values alignment

| Row | Candidate nucleotide | Reference nucleotide | Match score |
|---|---|---|---|
| 1 | A | A | 1 |
| 2 | T | T | 1 |
| 3 | U | T | 1 |
| 4 | C | C | 1 |
| 5 | G | G | 1 |
| 6 | A | N | 0 |
| 7 | T | N | 0 |
| 8 | C | N | 0 |
| 9 | G | N | 0 |
| 10 | N | A | 0 |
| 11 | N | T | 0 |
| 12 | N | C | 0 |
| 13 | N | G | 0 |
| 14 | N | N | 0 |

Method of Making TREMs, TREM Core Fragments, and TREM Fragments

In vitro methods for synthesizing oligonucleotides are known in the art and can be used to make a TREM, a TREM core fragment or a TREM fragment disclosed herein. For example, a TREM, TREM core fragment or TREM fragment can be synthesized using solid state synthesis or liquid phase synthesis.

In an embodiment, a TREM, a TREM core fragment or a TREM fragment made according to an in vitro synthesis method disclosed herein has a different modification profile compared to a TREM expressed and isolated from a cell, or compared to a naturally occurring tRNA.

An exemplary method for making a modified TREM is provided in Example 1. The method provided in Example 1 can also be used to make a synthetic TREM core fragment or synthetic TREM fragment. Additional exemplary methods for making a synthetic TREM via 5'-Silyl-2'-Orthoester (2'-ACE) Chemistry is provided in Example 4. The method provided in Example 4 can also be used to make a synthetic TREM core fragment or synthetic TREM fragment. Additional synthetic methods are disclosed in Hartsel S A et al., (2005) *Oligonucleotide Synthesis,* 033-050, the entire contents of which are hereby incorporated by reference.

TREM Composition

In an embodiment, a TREM composition, e.g., a TREM pharmaceutical composition, comprises a pharmaceutically acceptable excipient. Exemplary excipients include those provided in the FDA Inactive Ingredient Database (https://www.accessdata.fda.gov/scripts/cder/iig/index. Cfm).

In an embodiment, a TREM composition, e.g., a TREM pharmaceutical composition, comprises at least 1, 2, 3, 4, 5, 6, 7, 8, 9, 10, 15, 20, 30, 40, 50, 60, 70, 80, 90, 100 or 150 grams of TREM, TREM core fragment or TREM fragment.

In an embodiment, a TREM composition, e.g., a TREM pharmaceutical composition, comprises at least 1, 2, 3, 4, 5, 6, 7, 8, 9, 10, 15, 20, 30, 40, 50 or 100 milligrams of TREM, TREM core fragment or TREM fragment.

In an embodiment, a TREM composition, e.g., a TREM pharmaceutical composition, is at least 10, 20, 30, 40, 50, 60, 70, 80, 90, 95 or 99% dry weight TREMs, TREM core fragments or TREM fragments.

In an embodiment, a TREM composition comprises at least $1 \times 10^6$ TREM molecules, at least $1 \times 10^7$ TREM molecules, at least $1 \times 10^8$ TREM molecules or at least $1 \times 10^9$ TREM molecules.

In an embodiment, a TREM composition comprises at least $1 \times 10^6$ TREM core fragment molecules, at least $1 \times 10^7$ TREM core fragment molecules, at least $1\times10^8$ TREM core fragment molecules or at least $1\times10^9$ TREM core fragment molecules.

In an embodiment, a TREM composition comprises at least $1\times10^6$ TREM fragment molecules, at least $1\times10^7$ TREM fragment molecules, at least $1\times10^8$ TREM fragment molecules or at least $1\times10^9$ TREM fragment molecules.

In an embodiment, a TREM composition produced by any of the methods of making disclosed herein can be charged with an amino acid using an in vitro charging reaction as known in the art.

In an embodiment, a TREM composition comprise one or more species of TREMs, TREM core fragments, or TREM fragments. In an embodiment, a TREM composition comprises a single species of TREM, TREM core fragment, or TREM fragment. In an embodiment, a TREM composition comprises a first TREM, TREM core fragment, or TREM fragment species and a second TREM, TREM core fragment, or TREM fragment species. In an embodiment, the TREM composition comprises X TREM, TREM core fragment, or TREM fragment species, wherein x=2, 3, 4, 5, 6, 7, 8, 9, or 10.

In an embodiment, the TREM, TREM core fragment, or TREM fragment has at least 70, 75, 80, 85, 90, or 95, or has 100%, identity with a sequence encoded by a nucleic acid in Table 1.

In an embodiment, the TREM comprises a consensus sequence provided herein.

A TREM composition can be formulated as a liquid composition, as a lyophilized composition or as a frozen composition.

In some embodiments, a TREM composition can be formulated to be suitable for pharmaceutical use, e.g., a pharmaceutical TREM composition. In an embodiment, a pharmaceutical TREM composition is substantially free of materials and/or reagents used to separate and/or purify a TREM, TREM core fragment, or TREM fragment.

In some embodiments, a TREM composition can be formulated with water for injection. In some embodiments, a TREM composition formulated with water for injection is suitable for pharmaceutical use, e.g., comprises a pharmaceutical TREM composition.

TREM Characterization

A TREM, TREM core fragment, or TREM fragment, or a TREM composition, e.g., a pharmaceutical TREM composition, produced by any of the methods disclosed herein can be assessed for a characteristic associated with the TREM, TREM core fragment, or TREM fragment or the TREM composition, such as purity, sterility, concentration, structure, or functional activity of the TREM, TREM core fragment, or TREM fragment. Any of the above-mentioned characteristics can be evaluated by providing a value for the characteristic, e.g., by evaluating or testing the TREM, TREM core fragment, or TREM fragment, or the TREM composition, or an intermediate in the production of the TREM composition. The value can also be compared with a standard or a reference value. Responsive to the evaluation, the TREM composition can be classified, e.g., as ready for release, meets production standard for human trials, complies with ISO standards, complies with cGMP standards, or complies with other pharmaceutical standards. Responsive to the evaluation, the TREM composition can be subjected to further processing, e.g., it can be divided into aliquots, e.g., into single or multi-dosage amounts, disposed in a container, e.g., an end-use vial, packaged, shipped, or put into commerce. In embodiments, in response to the evaluation, one or more of the characteristics can be modulated, processed or re-processed to optimize the TREM composition. For example, the TREM composition can be modulated, processed or re-processed to (i) increase the purity of the TREM composition; (ii) decrease the amount of fragments in the composition; (iii) decrease the amount of endotoxins in the composition; (iv) increase the in vitro translation activity of the composition; (v) increase the TREM concentration of the composition; or (vi) inactivate or remove any viral contaminants present in the composition, e.g., by reducing the pH of the composition or by filtration.

In an embodiment, the TREM, TREM core fragment, or TREM fragment (e.g., TREM composition or an intermediate in the production of the TREM composition) has a purity of at least 30%, 40%, 50%, 60%, 70%, 80%, 85%, 90%, 91%, 92%, 93%, 94%, 95%, 96%, 97%, 98%, or 99%, i.e., by mass.

In an embodiment, the TREM (e.g., TREM composition or an intermediate in the production of the TREM composition) has less than 0.1%, 0.5%, 1%, 2%, 3%, 4%, 5%, 6%, 7%, 8%, 9%, 10%, 15%, 20%, 25% TREM fragments relative to full length TREMs.

In an embodiment, the TREM, TREM core fragment, or TREM fragment (e.g., TREM composition or an intermediate in the production of the TREM composition) has low levels or absence of endotoxins, e.g., a negative result as measured by the Limulus amebocyte lysate (LAL) test.

In an embodiment, the TREM, TREM core fragment, or TREM fragment (e.g., TREM composition or an intermediate in the production of the TREM composition) has in-vitro translation activity, e.g., as measured by an assay described in Examples 12-13.

In an embodiment, the TREM, TREM core fragment, or TREM fragment (e.g., TREM composition or an intermediate in the production of the TREM composition) has a TREM concentration of at least 0.1 ng/mL, 0.5 ng/ml, 1 ng/mL, 5 ng/ml, 10 ng/mL, 50 ng/mL, 0.1 ug/mL, 0.5 µg/mL, 1 µg/mL, 2 µg/mL, 5 µg/mL, 10 µg/mL, 20 µg/mL, 30 µg/mL, 40 µg/mL, 50 µg/mL, 60 µg/mL, 70 µg/mL, 80 µg/mL, 100 µg/mL, 200 µg/mL, 300 µg/mL, 500 µg/mL, 1000 µg/mL, 5000 µg/mL, 10,000 µg/mL, or 100,000 µg/mL.

In an embodiment, the TREM, TREM core fragment, or TREM fragment (e.g., TREM composition or an intermediate in the production of the TREM composition) is sterile, e.g., the composition or preparation supports the growth of fewer than 100 viable microorganisms as tested under aseptic conditions, the composition or preparation meets the standard of USP <71>, and/or the composition or preparation meets the standard of USP <85>.

In an embodiment, the TREM, TREM core fragment, or TREM fragment (e.g., TREM composition or an intermediate in the production of the TREM composition) has an undetectable level of viral contaminants, e.g., no viral contaminants. In an embodiment, any viral contaminant, e.g., residual virus, present in the composition is inactivated or removed. In an embodiment, any viral contaminant, e.g., residual virus, is inactivated, e.g., by reducing the pH of the composition. In an embodiment, any viral contaminant, e.g., residual virus, is removed, e.g., by filtration or other methods known in the field.

TREM Administration

Any TREM composition or pharmaceutical composition described herein can be administered to a cell, tissue or subject, e.g., by direct administration to a cell, tissue and/or an organ in vitro, ex-vivo or in vivo. In-vivo administration may be via, e.g., by local, systemic and/or parenteral routes, for example intravenous, subcutaneous, intraperitoneal, intrathecal, intramuscular, ocular, nasal, urogenital, intradermal, dermal, enteral, intravitreal, intracerebral, intrathecal, or epidural.

Vectors and Carriers

In some embodiments the TREM, TREM core fragment, or TREM fragment or TREM composition described herein, is delivered to cells, e.g. mammalian cells or human cells, using a vector. The vector may be, e.g., a plasmid or a virus. In some embodiments, delivery is in vivo, in vitro, ex vivo, or in situ. In some embodiments, the virus is an adeno associated virus (AAV), a lentivirus, or an adenovirus. In some embodiments, the system or components of the system are delivered to cells with a viral-like particle or a virosome. In some embodiments, the delivery uses more than one virus, viral-like particle or virosome.

Carriers

A TREM, a TREM composition or a pharmaceutical TREM composition described herein may comprise, may be formulated with, or may be delivered in, a carrier.

Viral Vectors

The carrier may be a viral vector (e.g., a viral vector comprising a sequence encoding a TREM, a TREM core fragment or a TREM fragment). The viral vector may be administered to a cell or to a subject (e.g., a human subject or animal model) to deliver a TREM, a TREM core fragment or a TREM fragment, a TREM composition or a pharmaceutical TREM composition.

A viral vector may be systemically or locally administered (e.g., injected). Viral genomes provide a rich source of vectors that can be used for the efficient delivery of exogenous genes into a mammalian cell. Viral genomes are known in the art as useful vectors for delivery because the polynucleotides contained within such genomes are typically incorporated into the nuclear genome of a mammalian cell by generalized or specialized transduction. These processes occur as part of the natural viral replication cycle, and do not require added proteins or reagents in order to induce gene integration. Examples of viral vectors include a retrovirus (e.g., Retroviridae family viral vector), adenovirus (e.g., Ad5, Ad26, Ad34, Ad35, and Ad48), parvovirus (e.g., adeno-associated viruses), coronavirus, negative strand RNA viruses such as orthomyxovirus (e.g., influenza virus), rhabdovirus (e.g., rabies and vesicular stomatitis virus), paramyxovirus (e.g., measles and Sendai), positive strand RNA viruses, such as picornavirus and alphavirus, and double stranded DNA viruses including adenovirus, herpesvirus (e.g., Herpes Simplex virus types 1 and 2, Epstein-Barr virus, cytomegalovirus, replication deficient herpes virus), and poxvirus (e.g., vaccinia, modified vaccinia Ankara (MVA), fowlpox and canarypox). Other viruses include Norwalk virus, togavirus, flavivirus, reoviruses, papovavirus, hepadnavirus, human papilloma virus, human foamy virus, and hepatitis virus, for example. Examples of retroviruses include: avian leukosis-sarcoma, avian C-type viruses, mammalian C-type, B-type viruses, D-type viruses, oncoretroviruses, HTLV-BLV group, lentivirus, alpharetrovirus, gammaretrovirus, spumavirus (Coffin, J. M., Retroviridae: The viruses and their replication, Virology (Third Edition) Lippincott-Raven, Philadelphia, 1996). Other examples include murine leukemia viruses, murine sarcoma viruses, mouse mammary tumor virus, bovine leukemia virus, feline leukemia virus, feline sarcoma virus, avian leukemia virus, human T-cell leukemia virus, baboon endogenous virus, Gibbon ape leukemia virus, Mason Pfizer monkey virus, simian immunodeficiency virus, simian sarcoma virus, Rous sarcoma virus and lentiviruses. Other examples of vectors are described, for example, in U.S. Pat. No. 5,801,030, the teachings of which are incorporated herein by reference. In some embodiments the system or components of the system are delivered to cells with a viral-like particle or a virosome.

Cell and Vesicle-Based Carriers

A TREM, a TREM core fragment or a TREM fragment, a TREM composition or a pharmaceutical TREM composition described herein can be administered to a cell in a vesicle or other membrane-based carrier.

In embodiments, a TREM, a TREM core fragment or a TREM fragment, or TREM composition, or pharmaceutical TREM composition described herein is administered in or via a cell, vesicle or other membrane-based carrier. In one embodiment, the TREM, TREM core fragment, TREM fragment, or TREM composition or pharmaceutical TREM composition can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi: 10.1155/2011/469679 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi: 10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

Lipid nanoparticles are another example of a carrier that provides a biocompatible and biodegradable delivery system for the TREM, TREM core fragment, TREM fragment, or TREM composition or pharmaceutical TREM composition described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a new type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi: 10.3390/nano7060122.

Exemplary lipid nanoparticles are disclosed in International Application PCT/US2014/053907, the entire contents of which are hereby incorporated by reference. For example, an LNP described in paragraphs [403-406] or [410-413] of PCT/US2014/053907 can be used as a carrier for the TREM, TREM core fragment, TREM fragment, or TREM composition or pharmaceutical TREM composition described herein.

Additional exemplary lipid nanoparticles are disclosed in U.S. Pat. No. 10,562,849 the entire contents of which are hereby incorporated by reference. For example, an LNP of formula (I) as described in columns 1-3 of U.S. Pat. No. 10,562,849 can be used as a carrier for the TREM, TREM core fragment, TREM fragment, or TREM composition or pharmaceutical TREM composition described herein.

Lipids that can be used in nanoparticle formations (e.g., lipid nanoparticles) include, for example those described in Table 4 of WO2019217941, which is incorporated by reference, e.g., a lipid-containing nanoparticle can comprise one or more of the lipids in Table 4 of WO2019217941. Lipid nanoparticles can include additional elements, such as polymers, such as the polymers described in Table 5 of WO2019217941, incorporated by reference.

In some embodiments, conjugated lipids, when present, can include one or more of PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2',3'-di(tetradecanoyloxy)propyl-1-0-(w-methoxy (polyethoxy)ethyl) butanedioate (PEG-S-DMG)), PEG dialkoxypropylcarbam, N-(carbonyl-methoxypoly ethylene glycol 2000)-1,2-distearoyl-sn-glycero-3-phosphoethanolamine sodium salt, and those described in Table 2 of WO2019051289 (incorporated by reference), and combinations of the foregoing.

In some embodiments, sterols that can be incorporated into lipid nanoparticles include one or more of cholesterol or cholesterol derivatives, such as those in WO2009/127060 or US2010/0130588, which are incorporated by reference. Additional exemplary sterols include phytosterols, including those described in Eygeris et al (2020), incorporated herein by reference.

In some embodiments, the lipid particle comprises an ionizable lipid, a non-cationic lipid, a conjugated lipid that inhibits aggregation of particles, and a sterol. The amounts of these components can be varied independently and to achieve desired properties. For example, in some embodiments, the lipid nanoparticle comprises an ionizable lipid is in an amount from about 20 mol % to about 90 mol % of the total lipids (in other embodiments it may be 20-70% (mol), 30-60% (mol) or 40-50% (mol); about 50 mol % to about 90 mol % of the total lipid present in the lipid nanoparticle), a non-cationic lipid in an amount from about 5 mol % to about 30 mol % of the total lipids, a conjugated lipid in an amount from about 0.5 mol % to about 20 mol % of the total lipids, and a sterol in an amount from about 20 mol % to about 50 mol % of the total lipids. The ratio of total lipid to nucleic acid can be varied as desired. For example, the total lipid to nucleic acid (mass or weight) ratio can be from about 10:1 to about 30:1.

In some embodiments, the lipid to nucleic acid ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and nucleic acid can be adjusted to provide a desired N/P ratio, for example, N/P ratio of 3, 4, 5, 6, 7, 8, 9, 10 or higher. Generally, the lipid nanoparticle formulation's overall lipid content can range from about 5 mg/ml to about 30 mg/mL.

Some non-limiting example of lipid compounds that may be used (e.g., in combination with other lipid components) to form lipid nanoparticles for the delivery of compositions described herein, e.g., nucleic acid (e.g., RNA) described herein includes.

(i)

In some embodiments an LNP comprising Formula (i) is used to deliver a TREM composition described herein to the liver and/or hepatocyte cells.

(ii)

In some embodiments an LNP comprising Formula (ii) is used to deliver a TREM composition described herein to the liver and/or hepatocyte cells.

(iii)

In some embodiments an LNP comprising Formula (iii) is used to deliver a TREM composition described herein to the liver and/or hepatocyte cells.

(iv)

(v)

In some embodiments an LNP comprising Formula (v) is used to deliver a TREM composition described herein to the liver and/or hepatocyte cells.

(vi)

(vii)

(viii)

In some embodiments an LNP comprising Formula (vi) is used to deliver a TREM composition described herein to the liver and/or hepatocyte cells.

In some embodiments an LNP comprising Formula (viii) is used to deliver a TREM composition described herein to the liver and/or hepatocyte cells.

(ix)

In some embodiments an LNP comprising Formula (ix) is used to deliver a TREM composition described herein to the liver and/or hepatocyte cells.

(x)

wherein $X^1$ is O, $NR^1$, or a direct bond, $X^2$ is C2-5 alkylene, $X^3$ is C(=O) or a direct bond, $R^1$ is H or Me, $R^3$ is Ci-3 alkyl, $R^2$ is Ci-3 alkyl, or $R^2$ taken together with the nitrogen atom to which it is attached and 1-3 carbon atoms of $X^2$ form a 4-, 5-, or 6-membered ring, or $X^1$ is $NR^1$, $R^1$ and $R^2$ taken together with the nitrogen atoms to which they are attached form a 5- or 6-membered ring, or $R^2$ taken together with $R^3$ and the nitrogen atom to which they are attached form a 5-, 6-, or 7-membered ring, $Y^1$ is C2-12 alkylene, $Y^2$ is selected from (in either orientation)

(in either orientation)

-continued (in either orientation)

n is 0 to 3, $R^4$ is Ci-15 alkyl, $Z^1$ is Ci-6 alkylene or a direct bond, $Z^2$ is (in either orientation) or absent, provided that if $Z^1$ is a direct bond, $Z^2$ is absent; $R^5$ is C5-9 alkyl or C6-10 alkoxy, $R^6$ is C5-9 alkyl or C6-10 alkoxy, W is methylene or a direct bond, and $R^7$ is H or Me, or a salt thereof, provided that if $R^3$ and $R^2$ are C2 alkyls, $X^1$ is O, $X^2$ is linear C3 alkylene, $X^3$ is C(=O), $Y^1$ is linear Ce alkylene, $(Y^2)$n-$R_4$ is $R_4$ is linear C5 alkyl, $Z^1$ is C2 alkylene, $Z^2$ is absent, W is methylene, and $R^7$ is H, then $R^5$ and $R^6$ are not Cx alkoxy.

In some embodiments an LNP comprising Formula (xii) is used to deliver a TREM composition described herein to the liver and/or hepatocyte cells.

(xi)

In some embodiments an LNP comprising Formula (xi) is used to deliver a TREM composition described herein to the liver and/or hepatocyte cells.

(xii)

where

R =

OF-02

R =

(xiii)

(xiv)

In some embodiments an LNP comprises a compound of Formula (xiii) and a compound of Formula (xiv).

(xv)

In some embodiments, an LNP comprising Formula (xv) is used to deliver a TREM composition described herein to the liver and/or hepatocyte cells.

(xvi)

PEI$_{000}$ Core

5

10

15

In some embodiments an LNP comprising a formulation of Formula (xvi) is used to deliver a TREM composition described herein to the lung endothelial cells.

(xvii)

X = amino structure (xviii) (a)

X=

-continued (xviii)(b)

(xix)

In some embodiments, a lipid compound used to form lipid nanoparticles for the delivery of compositions described herein, e.g., a TREM described herein is made by one of the following reactions:

(xx) (a)

(xx) (b)

In some embodiments, a composition described herein (e.g., TREM composition) is provided in an LNP that comprises an ionizable lipid. In some embodiments, the ionizable lipid is heptadecan-9-yl 8-((2-hydroxyethyl) (6-oxo-6-(undecyloxy) hexyl)amino) octanoate (SM-102); e.g., as described in Example 1 of U.S. Pat. No. 9,867,888

(incorporated by reference herein in its entirety). In some embodiments, the ionizable lipid is 9Z,12Z)-3-((4,4-bis(oc-tyloxy) butanoyl)oxy)-2-((((3-(diethylamino) propoxy) car-bonyl)oxy)methyl) propyl octadeca-9,12-dienoate (LP01), e.g., as synthesized in Example 13 of WO2015/095340 (incorporated by reference herein in its entirety). In some embodiments, the ionizable lipid is Di((Z)-non-2-en-1-yl) 9-((4-dimethylamino)-butanoyl)oxy) heptadecanedioate (L319), e.g. as synthesized in Example 7, 8, or 9 of US2012/ 0027803 (incorporated by reference herein in its entirety). In some embodiments, the ionizable lipid is 1,1'-((2-(4-(2-((2-(Bis(2-hydroxydodecyl)amino)ethyl) (2-hydroxydodecyl) amino)ethyl) piperazin-1-yl)ethyl) azanediyl)bis(dodecan-2-ol) (C12-200), e.g., as synthesized in Examples 14 and 16 of WO2010/053572 (incorporated by reference herein in its entirety). In some embodiments, the ionizable lipid is Imi-dazole cholesterol ester (ICE) lipid (3S,10R,13R, 17R)-10, 13-dimethyl-17-((R)-6-methylheptan-2-yl)-2, 3, 4, 7, 8, 9, 10, 11, 12, 13, 14, 15, 16, 17-tetradecahydro-1H-cyclopenta [a]phenanthren-3-yl 3-(1H-imidazol-4-yl) propanoate, e.g., Structure (I) from WO2020/106946 (incorporated by refer-ence herein in its entirety).

In some embodiments, an ionizable lipid may be a cat-ionic lipid, an ionizable cationic lipid, e.g., a cationic lipid that can exist in a positively charged or neutral form depending on pH, or an amine-containing lipid that can be readily protonated. In some embodiments, the cationic lipid is a lipid capable of being positively charged, e.g., under physiological conditions. Exemplary cationic lipids include one or more amine group(s) which bear the positive charge. In some embodiments, the lipid particle comprises a cationic lipid in formulation with one or more of neutral lipids, ionizable amine-containing lipids, biodegradable alkyne lipids, steroids, phospholipids including polyunsaturated lipids, structural lipids (e.g., sterols), PEG, cholesterol and polymer conjugated lipids. In some embodiments, the cationic lipid may be an ionizable cationic lipid. An exemplary cationic lipid as disclosed herein may have an effective pKa over 6.0. In embodiments, a lipid nanoparticle may comprise a second cationic lipid having a different effective pKa (e.g., greater than the first effective pKa), than the first cationic lipid. A lipid nanoparticle may comprise between 40 and 60 mol percent of a cationic lipid, a neutral lipid, a steroid, a polymer conjugated lipid, and a therapeutic agent, e.g., a TREM described herein, encapsulated within or associated with the lipid nanoparticle. In some embodiments, the TREM is co-formulated with the cationic lipid. The TREM may be adsorbed to the surface of an LNP, e.g., an LNP comprising a cationic lipid. In some embodiments, the TREM may be encapsulated in an LNP, e.g., an LNP comprising a cationic lipid. In some embodiments, the lipid nanoparticle may comprise a targeting moiety, e.g., coated with a targeting agent. In embodiments, the LNP formulation is biodegradable. In some embodiments, a lipid nanoparticle comprising one or more lipid described herein, e.g., Formula (i), (ii), (ii), (vii) and/or (ix) encapsulates at least 1%, at least 5%, at least 10%, at least 20%, at least 30%, at least 40%, at least 50%, at least 60%, at least 70%, at least 80%, at least 90%, at least 92%, at least 95%, at least 97%, at least 98% or 100% of a TREM.

Exemplary ionizable lipids that can be used in lipid nanoparticle formulations include, without limitation, those listed in Table 1 of WO2019051289, incorporated herein by reference. Additional exemplary lipids include, without limitation, one or more of the following formulae: X of US2016/0311759; I of US20150376115 or in US2016/0376224; I, II or III of US20160151284; I, IA, II, or IIA of US20170210967; I-c of US20150140070; A of US2013/0178541; I of US2013/0303587 or US2013/0123338; I of US2015/0141678; II, III, IV, or V of US2015/0239926; I of US2017/0119904; I or II of WO2017/117528; A of US2012/0149894; A of US2015/0057373; A of WO2013/116126; A of US2013/0090372; A of US2013/0274523; A of US2013/0274504; A of US2013/0053572; A of WO2013/016058; A of WO2012/162210; I of US2008/042973; I, II, III, or IV of US2012/01287670; I or II of US2014/0200257; I, II, or III of US2015/0203446; I or III of US2015/0005363; I, IA, IB, IC, ID, II, IIA, IIB, IIC, IID, or III-XXIV of US2014/0308304; of US2013/0338210; I, II, III, or IV of WO2009/132131; A of US2012/01011478; I or XXXV of US2012/0027796; XIV or XVII of US2012/0058144; of US2013/0323269; I of US2011/0117125; I, II, or III of US2011/0256175; I, II, III, IV, V, VI, VII, VIII, IX, X, XI, XII of US2012/0202871; I, II, III, IV, V, VI, VII, VIII, X, XII, XIII, XIV, XV, or XVI of US2011/0076335; I or II of US2006/008378; I of US2013/0123338; I or X-A-Y-Z of US2015/0064242; XVI, XVII, or XVIII of US2013/0022649; I, II, or III of US2013/0116307; I, II, or III of US2013/0116307; I or II of US2010/0062967; I-X of US2013/0189351; I of US2014/0039032; V of US2018/0028664; I of US2016/0317458; I of US2013/0195920; 5, 6, or 10 of U.S. Pat. No. 10,221,127; III-3 of WO2018/081480; I-5 or I-8 of WO2020/081938; 18 or 25 of U.S. Pat. No. 9,867,888; A of US2019/0136231; II of WO2020/219876; 1 of US2012/0027803; OF-02 of US2019/0240349; 23 of U.S. Pat. No. 10,086,013; cKK-E12/A6 of Miao et al (2020); C12-200 of WO2010/053572; 7C1 of Dahlman et al (2017); 304-O13 or 503-O13 of Whitehead et al; TS-P4C2 of U.S. Pat. No. 9,708,628; I of WO2020/106946; I of WO2020/106946.

In some embodiments, the ionizable lipid is MC3 (6Z, 9Z,28Z,31Z)-heptatriaconta-6,9,28,31-tetraen-19-yl-4-(dimethylamino)butanoate (DLin-MC3-DMA or MC3), e.g., as described in Example 9 of WO2019051289A9 (incorporated by reference herein in its entirety). In some embodiments, the ionizable lipid is the lipid ATX-002, e.g., as described in Example 10 of WO2019051289A9 (incorporated by reference herein in its entirety). In some embodiments, the ionizable lipid is (13Z,16Z)-A,A-dimethyl-3-nonyldocosa-13, 16-dien-1-amine (Compound 32), e.g., as described in Example 11 of WO2019051289A9 (incorporated by reference herein in its entirety). In some embodiments, the ionizable lipid is Compound 6 or Compound 22, e.g., as described in Example 12 of WO2019051289A9 (incorporated by reference herein in its entirety).

Exemplary non-cationic lipids include, but are not limited to, distearoyl-sn-glycero-phosphoethanolamine, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), monomethyl-phosphatidylethanolamine (such as 16-O-monomethyl PE), dimethyl-phosphatidylethanolamine (such as 16-O-dimethyl PE), 18-1-trans PE, 1-stearoyl-2-oleoyl-phosphatidyethanolamine (SOPE), hydrogenated soy phosphatidylcholine (HSPC), egg phosphatidylcholine (EPC), dioleoylphosphatidylserine (DOPS), sphingomyelin (SM), dimyristoyl phosphatidylcholine (DMPC), dimyristoyl phosphatidylglycerol (DMPG), distearoylphosphatidylglycerol (DSPG), dierucoylphosphatidylcholine (DEPC), palmitoyloleyolphosphatidylglycerol (POPG), dielaidoyl-phosphatidylethanolamine (DEPE), lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidicacid, cerebrosides, dicetylphosphate, lysophosphatidylcholine, dilinoleoylphosphatidylcholine, or mixtures thereof. It is understood that other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, paimitoyl, stearoyl, or oleoyl. Additional exemplary lipids, in certain embodiments, include, without limitation, those described in Kim et al. (2020) dx.doi.org/10.1021/acs.nanolett.0c01386, incorporated herein by reference. Such lipids include, in some embodiments, plant lipids found to improve liver transfection with mRNA (e.g., DGTS).

Other examples of non-cationic lipids suitable for use in the lipid nanoparticles include, without limitation, nonphosphorous lipids such as, e.g., stearylamine, dodeeylamine, hexadecylamine, acetyl palmitate, glycerol ricinoleate, hexadecyl stereate, isopropyl myristate, amphoteric acrylic polymers, triethanolamine-lauryl sulfate, alkyl-aryl sulfate polyethyloxylated fatty acid amides, dioctadecyl dimethyl ammonium bromide, ceramide, sphingomyelin, and the like. Other non-cationic lipids are described in WO2017/099823 or US patent publication US2018/0028664, the contents of which is incorporated herein by reference in their entirety.

In some embodiments, the non-cationic lipid is oleic acid or a compound of Formula I, II, or IV of US2018/0028664, incorporated herein by reference in its entirety. The non-cationic lipid can comprise, for example, 0-30% (mol) of the total lipid present in the lipid nanoparticle. In some embodiments, the non-cationic lipid content is 5-20% (mol) or 10-15% (mol) of the total lipid present in the lipid nanoparticle. In embodiments, the molar ratio of ionizable lipid to the neutral lipid ranges from about 2:1 to about 8:1 (e.g., about 2:1, 3:1, 4:1, 5:1, 6:1, 7:1, or 8:1).

In some embodiments, the lipid nanoparticles do not comprise any phospholipids.

In some aspects, the lipid nanoparticle can further comprise a component, such as a sterol, to provide membrane integrity. One exemplary sterol that can be used in the lipid nanoparticle is cholesterol and derivatives thereof. Non-limiting examples of cholesterol derivatives include polar analogues such as 5a-choiestanol, 53-coprostanol, choiesteryl-(2'-hydroxy)-ethyl ether, choiesteryl-(4'-hydroxy)-butyl ether, and 6-ketocholestanol; non-polar analogues such as 5a-cholestane, cholestenone, 5a-cholestanone, 5p-cholestanone, and cholesteryl decanoate; and mixtures thereof. In some embodiments, the cholesterol derivative is a polar analogue, e.g., choiesteryl-(4'-hydroxy)-butyl ether. Exemplary cholesterol derivatives are described in PCT publication WO2009/127060 and US patent publication US2010/0130588, each of which is incorporated herein by reference in its entirety.

In some embodiments, the component providing membrane integrity, such as a sterol, can comprise 0-50% (mol) (e.g., 0-10%, 10-20%, 20-30%, 30-40%, or 40-50%) of the total lipid present in the lipid nanoparticle. In some embodiments, such a component is 20-50% (mol) 30-40% (mol) of the total lipid content of the lipid nanoparticle.

In some embodiments, the lipid nanoparticle can comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as *ATTA*-lipid conjugates), cationic-polymer lipid (CPL) conjugates, and mixtures thereof. In some embodiments, the conjugated lipid molecule is a PEG-lipid conjugate, for example, a (methoxy polyethylene glycol)-conjugated lipid.

Exemplary PEG-lipid conjugates include, but are not limited to, PEG-diacylglycerol (DAG) (such as 1-(monomethoxy-polyethyleneglycol)-2,3-dimyristoylglyc-erol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2',3'-di(tetradecanoyloxy)pro-pyl-1-0-(w-methoxy (polyethoxy)ethyl)butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, US2017/0119904, and US/099823, the contents of all of which are incorporated herein by reference in their entirety. In some embodiments, a PEG-lipid is a compound of Formula III, III-a-I, III-a-2, III-b-1, III-b-2, or V of U$2018/0028664, the content of which is incorporated herein by reference in its entirety. In some embodiments, a PEG-lipid is of Formula II of US20150376115 or US2016/0376224, the content of both of which is incorporated herein by reference in its entirety. In some embodiments, the PEG-DAA conjugate can be, for example, PEG-dilauryloxypropyl, PEG-dimyristyloxypropyl, PEG-dipalmityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-disterylglycamide, PEG-cholesterol (1-[8'-(Cholest-5-en-3 [beta]-oxy) carboxamido-3',6'-dioxaoctanyl]carbamoyl-[omega]-methyl-poly(ethylene glycol), PEG-DMB (3,4-Ditetradecoxylbenzyl-[omega]-methyl-poly(ethylene glycol) ether), and 1,2-dimyristoyl-sn-glycero-3-phosphoethanolamine-N-[methoxy (polyethylene glycol)-2000]. In some embodiments, the PEG-lipid comprises PEG-DMG, 1,2-dimyristoyl-sn-glycero-3-phosphoethanolamine-N-[methoxy (polyethylene glycol)-2000]. In some embodiments, the PEG-lipid comprises a structure selected from:

-continued

In some embodiments, lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (GPL) conjugates can be used in place of or in addition to the PEG-lipid.

Exemplary conjugated lipids, i.e., PEG-lipids, (POZ)-lipid conjugates, *ATTA*-lipid conjugates and cationic polymer-lipids are described in the PCT and LIS patent applications listed in Table 2 of WO2019051289A9, the contents of all of which are incorporated herein by reference in their entirety.

In some embodiments, the PEG or the conjugated lipid can comprise 0-20% (mol) of the total lipid present in the lipid nanoparticle. In some embodiments, PEG or the conjugated lipid content is 0.5-10% or 2-5% (mol) of the total lipid present in the lipid nanoparticle. Molar ratios of the ionizable lipid, non-cationic-lipid, sterol, and PEG/conjugated lipid can be varied as needed. For example, the lipid particle can comprise 30-70% ionizable lipid by mole or by total weight of the composition, 0-60% cholesterol by mole or by total weight of the composition, 0-30% non-cationic-lipid by mole or by total weight of the composition and 1-10% conjugated lipid by mole or by total weight of the composition. Preferably, the composition comprises 30-40% ionizable lipid by mole or by total weight of the composition, 40-50% cholesterol by mole or by total weight of the composition, and 10-20% non-cationic-lipid by mole or by total weight of the composition. In some other embodiments, the composition is 50-75% ionizable lipid by mole or by total weight of the composition, 20-40% cholesterol by mole or by total weight of the composition, and 5 to 10% non-cationic-lipid, by mole or by total weight of the composition and 1-10% conjugated lipid by mole or by total weight of the composition. The composition may contain 60-70% ionizable lipid by mole or by total weight of the composition, 25-35% cholesterol by mole or by total weight of the composition, and 5-10% non-cationic-lipid by mole or by total weight of the composition. The composition may also contain up to 90% ionizable lipid by mole or by total weight of the composition and 2 to 15% non-cationic lipid by mole or by total weight of the composition. The formulation may also be a lipid nanoparticle formulation, for example comprising 8-30% ionizable lipid by mole or by total weight of the composition, 5-30% non-cationic lipid by mole or by total weight of the composition, and 0-20% cholesterol by mole or by total weight of the composition; 4-25% ionizable lipid by mole or by total weight of the composition, 4-25% non-cationic lipid by mole or by total weight of the composition, 2 to 25% cholesterol by mole or by total weight of the composition, 10 to 35% conjugate lipid by mole or by total weight of the composition, and 5% cholesterol by mole or by total weight of the composition; or 2-30% ionizable lipid by mole or by total weight of the composition, 2-30% non-cationic lipid by mole or by total weight of the composition, 1 to 15% cholesterol by mole or by total weight of the composition, 2 to 35% conjugate lipid by mole or by total weight of the composition, and 1-20% cholesterol by mole or by total weight of the composition; or even up to 90% ionizable lipid by mole or by total weight of the composition and 2-10% non-cationic lipids by mole or by total weight of the composition, or even 100% cationic lipid by mole or by total weight of the composition. In some embodiments, the lipid particle formulation comprises ionizable lipid, phospholipid, cholesterol and a PEG-ylated lipid in a molar ratio of 50:10:38.5:1.5. In some other embodiments, the lipid particle formulation comprises ionizable lipid, cholesterol and a PEG-ylated lipid in a molar ratio of 60:38.5:1.5.

In some embodiments, the lipid particle comprises ionizable lipid, non-cationic lipid (e.g. phospholipid), a sterol (e.g., cholesterol) and a PEG-ylated lipid, where the molar ratio of lipids ranges from 20 to 70 mole percent for the ionizable lipid, with a target of 40-60, the mole percent of non-cationic lipid ranges from 0 to 30, with a target of 0 to 15, the mole percent of sterol ranges from 20 to 70, with a target of 30 to 50, and the mole percent of PEG-ylated lipid ranges from 1 to 6, with a target of 2 to 5.

In some embodiments, the lipid particle comprises ionizable lipid/non-cationic-lipid/sterol/conjugated lipid at a molar ratio of 50:10:38.5:1.5.

In an aspect, the disclosure provides a lipid nanoparticle formulation comprising phospholipids, lecithin, phosphatidylcholine and phosphatidylethanolamine.

In some embodiments, one or more additional compounds can also be included. Those compounds can be administered separately, or the additional compounds can be included in the lipid nanoparticles of the invention. In other words, the lipid nanoparticles can contain other compounds in addition to the nucleic acid or at least a second nucleic acid, different than the first. Without limitations, other additional compounds can be selected from the group consisting of small or large organic or inorganic molecules, monosaccharides, disaccharides, trisaccharides, oligosaccharides, polysaccharides, peptides, proteins, peptide analogs and derivatives thereof, peptidomimetics, nucleic acids, nucleic acid analogs and derivatives, an extract made from biological materials, or any combinations thereof.

In some embodiments, LNPs are directed to specific tissues by the addition of targeting domains. For example, biological ligands may be displayed on the surface of LNPs to enhance interaction with cells displaying cognate receptors, thus driving association with and cargo delivery to tissues wherein cells express the receptor. In some embodiments, the biological ligand may be a ligand that drives delivery to the liver, e.g., LNPs that display GalNAc result in delivery of nucleic acid cargo to hepatocytes that display asialoglycoprotein receptor (ASGPR). The work of Akinc et al. Mol Ther 18 (7): 1357-1364 (2010) teaches the conjugation of a trivalent GalNAc ligand to a PEG-lipid (GalNAc-PEG-DSG) to yield LNPs dependent on ASGPR for observable LNP cargo effect (see, e.g., FIG. 6 of Akinc et al.

2010, supra). Other ligand-displaying LNP formulations, e.g., incorporating folate, transferrin, or antibodies, are discussed in WO2017223135, which is incorporated herein by reference in its entirety, in addition to the references used therein, namely Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol.

2011 721:339-353; Subramanya et al., Mol Ther. 2010 18:2028-2037; Song et al., Nat Biotechnol. 2005 23:709-717; Peer et al., Science. 2008 319:627-630; and Peer and Lieberman, Gene Ther. 2011 18:1127-1133.

In some embodiments, LNPs are selected for tissue-specific activity by the addition of a Selective ORgan Targeting (SORT) molecule to a formulation comprising traditional components, such as ionizable cationic lipids, amphipathic phospholipids, cholesterol and poly(ethylene glycol) (PEG) lipids. The teachings of Cheng et al. Nat Nanotechnol 15 (4): 313-320 (2020) demonstrate that the addition of a supplemental "SORT" component precisely alters the in vivo RNA delivery profile and mediates tissue-specific (e.g., lungs, liver, spleen) gene delivery and editing as a function of the percentage and biophysical property of the SORT molecule.

In some embodiments, the LNPs comprise biodegradable, ionizable lipids. In some embodiments, the LNPs comprise (9Z,12Z)-3-((4,4-bis(octyloxy) butanoyl)oxy)-2-((((3-(di-ethylamino) propoxy) carbonyl)oxy)methyl) propyl octa-deca-9,12-dienoate, also called 3-((4,4-bis(octyloxy) butanoyl)oxy)-2-((((3-(diethylamino) propoxy) carbonyl) oxy)methyl) propyl (9Z,12Z)-octadeca-9,12-dienoate) or another ionizable lipid. See, e.g, lipids of WO2019/067992, WO/2017/173054, WO2015/095340, and WO2014/136086, as well as references provided therein. In some embodiments, the term cationic and ionizable in the context of LNP lipids is interchangeable, e.g., wherein ionizable lipids are cationic depending on the pH.

In some embodiments, the average LNP diameter of the LNP formulation may be between 10s of nm and 100s of nm, e.g., measured by dynamic light scattering (DLS). In some embodiments, the average LNP diameter of the LNP for-mulation may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the average LNP diameter of the LNP formulation may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In some embodi-ments, the average LNP diameter of the LNP formulation may be from about 70 nm to about 100 nm. In a particular embodiment, the average LNP diameter of the LNP formu-lation may be about 80 nm. In some embodiments, the average LNP diameter of the LNP formulation may be about 100 nm. In some embodiments, the average LNP diameter of the LNP formulation ranges from about 1 mm to about 500 mm, from about 5 mm to about 200 mm, from about 10 mm to about 100 mm, from about 20 mm to about 80 mm, from about 25 mm to about 60 mm, from about 30 mm to about 55 mm, from about 35 mm to about 50 mm, or from about 38 mm to about 42 mm.

A LNP may, in some instances, be relatively homogenous. A polydispersity index may be used to indicate the homo-geneity of a LNP, e.g., the particle size distribution of the lipid nanoparticles. A small (e.g., less than 0.3) polydisper-sity index generally indicates a narrow particle size distri-bution. A LNP may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a LNP may be from about 0.10 to about 0.20.

The zeta potential of a LNP may be used to indicate the electrokinetic potential of the composition. In some embodi-ments, the zeta potential may describe the surface charge of an LNP. Lipid nanoparticles with relatively low charges, positive or negative, are generally desirable, as more highly charged species may interact undesirably with cells, tissues, and other elements in the body. In some embodiments, the zeta potential of a LNP may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

The efficiency of encapsulation of a TREM describes the amount of TREM that is encapsulated or otherwise associ-ated with a LNP after preparation, relative to the initial amount provided. The encapsulation efficiency is desirably high (e.g., close to 100%). The encapsulation efficiency may be measured, for example, by comparing the amount of TREM in a solution containing the lipid nanoparticle before and after breaking up the lipid nanoparticle with one or more organic solvents or detergents. An anion exchange resin may be used to measure the amount of free protein or nucleic acid (e.g., RNA) in a solution. Fluorescence may be used to measure the amount of free TREM in a solution. For the lipid nanoparticles described herein, the encapsulation effi-ciency of a TREM may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In some embodiments, the encapsulation efficiency may be at least 90%. In some embodiments, the encapsu-lation efficiency may be at least 95%.

A LNP may optionally comprise one or more coatings. In some embodiments, a LNP may be formulated in a capsule, film, or table having a coating. A capsule, film, or tablet including a composition described herein may have any useful size, tensile strength, hardness or density.

Additional exemplary lipids, formulations, methods, and characterization of LNPs are taught by WO2020061457, which is incorporated herein by reference in its entirety.

In some embodiments, in vitro or ex vivo cell lipofections are performed using Lipofectamine MessengerMax (Thermo Fisher) or TransIT-mRNA Transfection Reagent (Mirus Bio). In certain embodiments, LNPs are formulated using the GenVoy_ILM ionizable lipid mix (Precision Nano-Systems). In certain embodiments, LNPs are formulated using 2,2-dilinoleyl-4-dimethylaminoethyl-[1,3]-dioxolane (DLin-KC2-DMA) or dilinoleylmethyl-4-dimethylami-nobutyrate (DLin-MC3-DMA or MC3), the formulation and in vivo use of which are taught in Jayaraman et al. Angew Chem Int Ed Engl 51 (34): 8529-8533 (2012), incorporated herein by reference in its entirety.

LNP formulations optimized for the delivery of CRISPR-Cas systems, e.g., Cas9-gRNA RNP, gRNA, Cas9 mRNA, are described in WO2019067992 and WO2019067910, both incorporated by reference.

Additional specific LNP formulations useful for delivery of nucleic acids are described in U.S. Pat. Nos. 8,158,601 and 8,168,775, both incorporated by reference, which include formulations used in patisiran, sold under the name ONPATTRO.

Exosomes can also be used as drug delivery vehicles for the TREM, TREM core fragment, TREM fragment, or TREM compositions or pharmaceutical TREM composition described herein. For a review, see Ha et al. July 2016. Acta Pharmaceutica Sinica B. Volume 6, Issue 4, Pages 287-296; https://doi.org/10.1016/j.apsb.2016.02.001.

Ex vivo differentiated red blood cells can also be used as a carrier for a TREM, TREM core fragment, TREM fragment, or TREM composition, or pharmaceutical TREM composition described herein. See, e.g., WO2015073587; WO2017123646; WO2017123644; WO2018102740; WO2016183482; WO2015153102; WO2018151829; WO2018009838; Shi et al. 2014. Proc Natl Acad Sci USA. 111 (28): 10131-10136; U.S. Pat. No. 9,644,180; Huang et al. 2017. Nature Communications 8:423; Shi et al. 2014. Proc Natl Acad Sci USA. 111 (28): 10131-10136.

Fusosome compositions, e.g., as described in WO2018208728, can also be used as carriers to deliver the TREM, TREM core fragment, TREM fragment, or TREM composition, or pharmaceutical TREM composition described herein.

Virosomes and virus-like particles (VLPs) can also be used as carriers to deliver a TREM, TREM core fragment, TREM fragment, or TREM composition, or pharmaceutical TREM composition described herein to targeted cells.

Plant nanovesicles, e.g., as described in WO2011097480A1, WO2013070324A1, or WO2017004526A1 can also be used as carriers to deliver the TREM, TREM core fragment, TREM fragment, or TREM composition, or pharmaceutical TREM composition described herein.

Delivery without a Carrier

A TREM, a TREM core fragment or a TREM fragment, a TREM composition or a pharmaceutical TREM composition described herein can be administered to a cell without a carrier, e.g., via naked delivery of the TREM, a TREM core fragment or a TREM fragment, a TREM composition or a pharmaceutical TREM composition.

In some embodiments, naked delivery as used herein refers to delivery without a carrier. In some embodiments, delivery without a carrier, e.g., naked delivery, comprises delivery with a moiety, e.g., a targeting peptide.

In some embodiments, a TREM, a TREM core fragment or a TREM fragment, or TREM composition, or pharmaceutical TREM composition described herein is delivered to a cell without a carrier, e.g., via naked delivery. In some embodiments, the delivery without a carrier, e.g., naked delivery, comprises delivery with a moiety, e.g., a targeting peptide.

Use of TREMs

A TREM composition (e.g., a pharmaceutical TREM composition described herein) can modulate a function in a cell, tissue or subject. In embodiments, a TREM composition (e.g., a pharmaceutical TREM composition) described herein is contacted with a cell or tissue, or administered to a subject in need thereof, in an amount and for a time sufficient to modulate (increase or decrease) one or more of the following parameters: adaptor function (e.g., cognate or non-cognate adaptor function), e.g., the rate, efficiency, robustness, and/or specificity of initiation or elongation of a polypeptide chain; ribosome binding and/or occupancy; regulatory function (e.g., gene silencing or signaling); cell fate; mRNA stability; protein stability; protein transduction; protein compartmentalization. A parameter may be modulated, e.g., by at least 5% (e.g., at least 10%, 15%, 20%, 25%, 30%, 40%, 50%, 60%, 70%, 80%, 90%, 100%, 150%, 200% or more) compared to a reference tissue, cell or subject (e.g., a healthy, wild-type or control cell, tissue or subject).

All references and publications cited herein are hereby incorporated by reference.

The following examples are provided to further illustrate some embodiments of the present invention, but are not intended to limit the scope of the invention; it will be understood by their exemplary nature that other procedures, methodologies, or techniques known to those skilled in the art may alternatively be used.

EXAMPLES

Table of Contents for Examples

Example 1  Synthesis of modified TREMs
Example 2  Synthesis of guanosine 2'-O-MOE phosphoramidite
Example 3  Synthesis of 5,6 dihydrouridine
Example 4  Synthesis of a TREM via 5'-Silyl-2'-Orthoester (2'-ACE) Chemistry
Example 5  Synthesis of an arginine TREM having a 2'-O-MOE modification
Example 6  Method of synthesizing a glutamine TREM having a pseudouridine modification
Example 7  HPLC and MS analysis of modified TREMs
Example 8  Analysis of modified TREMs via anion-exchange HPLC
Example 9  Analysis of TREMs via PAGE Purification and Analysis
Example 10 Deprotection of synthesized TREM
Example 11 Characterization of chemically modified TREMs for readthrough of a premature termination codon (PTC) in a reporter protein
Example 12 Correction of a mis sense mutation in an ORF with administration of a TREM
Example 13 Evaluation of protein expression levels of SMC-containing ORF with administration of a TREM
Example 14 Modulation of translation rate of SMC-containing ORF with TREM administration Example 1: Synthesis of a Modified TREM Generally, TREM molecules (e.g., modified TREMs) may be chemically synthesized and purified by HPLC according to standard solid phase synthesis methods using phosphoramidite chemistry. (see, e.g., Scaringe S. et al. (2004) *Curr Protoc Nucleic Acid Chem,* 2.10.1-2.10.16; Usman N. et al. (1987) *J. Am. Chem. Soc,* 109, 7845-7854). Individually modified TREM molecules containing one or more 2'-methoxy (2'OMe), 2'fluoro (2'F), 2'-methoxyethyl(2'-MOE), or phosphorothioate (PS) modifications were prepared using either TREM-Arg-TGA, TREM-Ser-TAG, or TREM-Gln-TAA sequences as a framework according to phosphoramidite technology on solid phase used in oligonucleotide synthesis. For clarity, the arginine non-cognate TREM molecule named TREM-Arg-TGA contains the sequence of ARG-UCU-TREM body but with the anticodon sequence corresponding to UCA instead of UCU (i.e., SEQ ID NO: 622). Similarly, a serine non-cognate TREM molecule named TREM-Ser-TAG contains the sequence of SER-GCU-TREM body but with the anticodon sequence corresponding to CUA instead of GCU (i.e., SEQ ID NO: 993). A glutamine non-cognate TREM molecule named TREM-Gln-TAA contains the sequence of GLN-CUG-TREM body but with the anticodon sequence corresponding to UUA instead of CUG (i.e., SEQ ID NO: 1079).

To make the 2'OMe modified TREMs, the following 2'-O-methyl phosphoramidites were used: (5'-O-dimethoxytrityl-N6-(benzoyl)-2'-O-methyl-adenosine-3'-O-(2-cyanoethyl-N,N-diisopropy-lamino)phosphoramidite, 5'-O-dimethoxy-trityl-N4-(acetyl)-2'-O-methyl-cytidine-3'-O-(2-cyanoethyl-N,N-diisopropyl-amino)phosphoramidite, (5'-O-dimethoxytrityl-N2-(isobutyryl)-2'-O-methyl-guanosine-3'-O-(2-cyano-ethyl-N,N-diisopropylamino)-phosphoramidite, and 5'-O-dimethoxy-trityl-2'-O-methyluridine-3'-O-(2-cyanoethyl-N,N-diisopropylamino) phosphoramidite. To make the 2'-deoxy and 2'-F modified TREMs, analogous 2'-deoxy and 2'-fluoro-phosphoramidites with the same protecting groups as the 2'-O-methyl RNA amidites were used. To make the 2'-MOE modified TREMs, the following 2'-MOE-phosphoramidites were used: 5'-O-(4,4'-Dimethoxytrityl)-2'-O-methoxyethyl-N6-benzoyl-adenosine-3'-O-[(2-cyanoethyl)-(N,N-diisopropyl)]-phosphoramidite, 5'-O-(4,4'-Dimethoxytrityl)-2'-O-methoxyethyl-5-methyl-N4-benzoyl-cytidine-3'-O-[(2-cyanoethyl)-(N,N-diisopropyl)]-phosphoramidite, 5'-O-(4,4'-Dimethoxytrityl)-2'-O-methoxyethyl-N2-isobutyryl-guanosine-3'-O-[(2-cyanoethyl)-(N,N-diisopropyl)]-phosphoramidite, 5'-O-(4,4'-Dimethoxytrityl)-2'-O-methoxyethyl-5-methyl-uridine-3'-O-[(2-cyanoethyl)-(N,N-diisopropyl)]-phosphoramidite.

During the oligonucleotide synthesis via this phosphoramidites approach, the phosphorothioate was introduced by oxidizing the phosphite triester using a sulfur transfer reagent, such as tetraethylthiuram disulfide (TETD), bis(O, O-diisopropoxy phosphinothioyl) disulfide (Stec's reagent), 3H-1,2-benzodithiol-3-one-1,1,-dioxide (Beaucage reagent), phenylacetyl disulfide (PADS), 3-ethoxy-1,2,4-dithiazoline-5-one (EDITH), 1,2-dithiazole-5-thione (xanthane hydride or ADTT), 3-((dimethylamino-methylidene) amino)-3H-1,2,4-dithiazole-3-thione (DDTT), dimethylthiuram disulfide (DTD), 3-phenyl-1,2,4-dithiazoline-5-one (PolyOrg Sulfa or POS).

Tables 15-22 below describe a series of singly and multiply modified TREMs synthesized according to this procedure. The sequences of each of these TREMs are provided in the table, wherein r: ribonucleotide; m: 2'-OMe; *: PS linkage; f: 2'-fluoro; moe: 2'-moe; d: deoxyribonucleotide; 5MeC: 5-methylcytosine. Thus, for example, mA represents 2'-O-methyl adenosine, moe5MeC represents 2'-MOE nucleotide with 5-methylcytosine nucleobase, and dA represents an adenosine deoxyribonucleotide.

Example 2: Synthesis of Guanosine 2'-O-MOE Phosphoramidite

This example describes the synthesis of guanosine 2'-O-MOE phosphoramidite. Guanosine 2'-O-MOE phosphoramidite is prepared and purified according to previously published procedures (Wen K. et al. (2002) *The Journal of Organic Chemistry*, 67 (22), 7887-7889).

Briefly, guanosine and imidazole are dried by co-evaporation with pyridine, dissolved in dry DMF, and treated with bis(diisopropylchlorosilyl) methane added dropwise at 0° C. The temperature is gradually increased to 25° C. and then held for 5 h. The reaction mixture is poured into ice water, and the precipitated white solid filtered to afford compound 1. To a solution of compound 1, BrCH2CH2OCH3, and TBAI in DMF at −20° C. is added with sodium bis(trimethylsilyl)amide, and the mixture is stirred for 4 hours under argon. After the reaction is quenched with methanol, the THF is evaporated and the residue is precipitated in ice to furnish compound 2. TBAF is added to a solution of compound 2 at 25° C. and then the mixture is stirred at 35° C. for 5 hours. The solvent is then evaporated under reduced pressure, and the residue is filtered in a short pad of silica gel using 10% methanol in dichloromethane to afford guanosine 2'-O-MOE phosphoramidite.

Example 3: Synthesis of 5,6 Dihydrouridine

This example describes the synthesis of 5,6 dihydrouridine. 5,6 dihydrouridine phosphoramidite is prepared and purified according to previously published procedures (Hanze A R et al., (1967) *Journal of the American Chemical Society*, 89 (25), 6720-6725). Briefly, oxygen is bubbled through a solution uridine in the presence of platinum black. The reaction is followed by spotting the reaction mixture on silica gel thin layer chromatographic plates and developing in methanol-chloroform (1:1). After 1 hour, the mixture is cooled and centrifuged and the clear liquid lyophilized to yield the 5,6 dihydrouridine product.

Example 4: Synthesis of a TREM Via 5'-Silyl-2'-Orthoester (2'-ACE) Chemistry This example describes the synthesis of a TREM via 5'-Silyl-2'-Orthoester (2'-ACE) Chemistry summarized from (Hartsel S A et al., (2005) *Oligonucleotide Synthesis*, 033-050).

Protected Ribonucleoside Monomers

5'-O-silyl-2'-O-ACE protected phosphoramidites are prepared and purified according to previously published procedures (Hartsel S A et al., (2005) *Oligonucleotide Synthesis*, 033-050). Briefly, monomer synthesis begins from standard base-protected ribonucleosides [rA(ibu), rC(acetyl), rG(ibu) and U]. Orthogonal, 5'-silyl-2'-ACE protection and amidite preparation is then accomplished in five general steps:

1. Simultaneous transient protection of the 5'- and 3'-hydroxyl groups with 1,1,3,3tetraisopropyldisiloxane (TIPS).
2. Regiospecific conversion of the 2'-hydroxyl to the 2'-O-orthoester using tris(acetoxyethyl) orthoformate (ACE orthoformate).
3. Removal of the 5',3'-TIPS protection.
4. Introduction of the 5'-O-silyl ether protecting group using benzhydryloxybis-(trimethylsilyloxy)-chlorosilane (BzH-C1).
5. Phosphitylation of the 3'-OH with bis(N,N'-diisopropylamino)methoxyphosphine.

The fully protected, phosphitylated monomer is an oil. For ease of handling and dissolution, the phosphoramidite solution is evaporated to dryness in a tared flask to enable quantitation of yields. The phosphoramidite oil is then dissolved in anhydrous acetonitrile, distributed into synthesis vials in 1.0-mmol aliquots, and evaporated to dryness under vacuum in the presence of potassium hydroxide (KOH) and P2O5.

Synthesis of Oligoribonucleosides

TABLE 12

| Synthesis Step | Reagent | Delivery Time | Reaction Time |
|---|---|---|---|
| Deblock | 3% DCA in DCM | 35 | |
| Activator | 0.5M S-ethyl-tetrazole | 6 | |
| Coupling | 0.1M amidite8.0 | 30 | |
| | 0.5M S-ethyl-tetrazole | 8 | 30 |
| Repeat Coupling | | | |
| Oxidation | t-Butyl hydroperoxide | 20 | 10 |
| Repeat Oxidation Delivery | | | |
| Capping | 1-methylimidazole and acetic anhydride | 12 | 10 |
| Desilylation | TEAHF | 35 | |

5'-silyl-2'-ACE oligoribonucleotide synthesis begins with the appropriately modified 3'-terminal nucleoside attached through the 3'-hydroxyl to a polystyrene support. The solid support contained in an appropriate reaction cartridge is then placed on the appropriate column position on the instrument. A synthesis cycle is created using the delivery times and wait steps outlined in Table 12.

1. Initial detritylation: The first step in the synthesis cycle is the removal of the 5' O-DMT from the nucleoside-bound polystyrene support using 3% DCA in DCM.
2. Coupling: The 5-ethylthio-1H-tetrazole solution is delivered to the solid support, followed by simultaneous delivery of an equal quantity of activator and phosphoramidite solution. Depending on the desired sequence and synthesis scale, excess activator and activator plus amidite are alternately delivered repeatedly to increase coupling efficiency, which is typically in excess of 99% per coupling reaction. The 5-ethylthio-1H-tetrazole activates coupling by protonating the diisopropyl amine attached to the trivalent phosphorous. Nucleophilic attack of the 5-ethylthio-1H-tetrazole leads to the formation of the tetrazolide intermediate that reacts with the free 5'-OH of the support-bound nucleoside forming the internucleotide phosphite linkage.
3. Oxidation: In the next step of chain elongation, the phosphorous (III) linkage is oxidized for 10-20 s to the more stable and ultimately desired P(V) linkage using t-butylhydroperoxide.
4. Capping: Although delivery of excess activator and phosphoramidite increases coupling efficiency, a small percentage of unreacted nucleoside may remain support-bound. To prevent the introduction of mixed sequences, the unreacted 5'-OH are "capped" or blocked by acetylating the primary hydroxyl. This acetylation is achieved through simultaneous delivery of 1-methylimidazole and acetic anhydride.
5. 5'-Desilylation: Before the next nucleoside in the sequence can be added to the growing oligonucleotide chain, the 5'-silyl group is removed with fluoride ion. This requires the delivery of triethylamine trihydrogenfluoride for 45 s. The desilylation is rapid and quantitative and no wait step is required.

Steps 2-5 are repeated for each subsequent nucleotide until the desired sequence is constructed.

Oligonucleotide Deprotection

A two-stage rapid deprotection strategy is employed to remove phosphate backbone protection, release the oligonucleotide from the solid support, and remove the exocyclic amine protecting groups on A, G, and C. The treatment also removes the acetyl moiety from the acetoxyethyl orthoester, resulting in the 2'-bis-hydroxyethyl protected intermediate that is now 10 times more labile to final acid deprotection. In the first deprotection step, S2Na2 is used to selectively remove the methyl protection from the internucleotide phosphate, leaving the oligoribonucleotide attached to the polystyrene support. This configuration allows any residual reagent to be thoroughly washed away before proceeding. Alternatively, a multicolumn, manifold approach can also be used.

1. A syringe barrel is attached to one of the two luer fittings on the synthesis column. 2 mL of the S2Na2 reagent is drawn into a second syringe and attached to the opposite side of the synthesis column. The S2Na2 reagent is gently pushed through the column and into the empty syringe barrel continuing back and forth several times. The column, filled with reagent is allowed to sit at room temperature for 10 min.
2. S2Na2 reagent is removed from the column. Using a clean syringe, the column is washed thoroughly with water. In the second deprotection step, 40% 1-methylamine in water is used to free the oligoribonucleotide from the solid support, deprotect the exocyclic base amines, and deacylate the 2'-orthoester leaving the deprotected species.

N-Methylamine Deprotection

1. The solid support resin is transferred from the column into a 4-mL vial
2. 2 mL 40% methylamine is added and heated for 12 min at 60° C.
3. The methylamine is removed and is transferred into a fresh vial.
4. The oligonucleotide solution is evaporated to dryness in a SpeedVac or similar device.

Oligonucleotide yields are measured using an ultraviolet (UV) spectrophotometer (absorbance at 260 nm).

Example 5: Synthesis of an Arginine TREM Having a 2'-O-MOE Modification

This example describes the synthesis of an Arg TREM having one 2'-O-MOE modification. The 2'-O-MOE modification can be placed on a nucleotide on any domain or linker of the Arg TREM, or at any position in said domain or linker.

A 2'-ACE RNA oligoribonucleotide synthesis is performed on a modified Applied Biosystems 394 DNA/RNA synthesizer or similar instrument. 2'-O-MOE amidites are synthesized as in Example 2. An oligonucleotide sequence: GGCUCCGUGGCGCAAUGGAUAGCGCAUUGGAC-UUCUAAUUCAAAGGUUCCGGGUU CG(A-MOE)GU-CCCGGCGGAGUCG (SEQ ID NO: 1290) is synthesized following the protocol described in example 4. A similar method can be used to add a 2'-O-MOE modification on a TREM specifying any one of the other 19 amino acids.

Example 6: Synthesis of a Glutamine TREM Having a Pseudouridine Modification

This example describes the synthesis of a Gln TREM having a pseudouridine modification. The modification can be placed on a nucleotide on any domain or linker of the Gln TREM, or at any position in said domain or linker.

A 2'-ACE RNA oligoribonucleotide synthesis is performed on a modified Applied Biosystems 394 DNA/RNA synthesizer or similar instrument. Pseudouridine (P) amidites are obtained from Glen Research or similar provider. An oligonucleotide sequence: GGUUCCAUG-GUGPAAUGGUAAGCACUCUGGACUCT-GAAUCCAGCGAUCCGAGUUC GAGUCUCGGUGGAACCUCCA (SEQ ID NO: 1291) is synthesized following the protocol described in example 4.

A similar method can be used to add a pseudouridine modification on a TREM specifying any one of the other 19 amino acids.

Example 7: HPLC and MS Analysis of Modified TREMs

Chemically modified TREM molecules may be analyzed by HPLC, for example, to evaluate the purity and homogeneity of the compositions. A Waters Aquity UPLC system using a Waters BEH C18 column (2.1 mm×50 mm×1.7 μm) may be used for this analysis. Samples may be prepared by dissolving 0.5 nmol of the TREM in 75 μL of water and injecting 2 μL of the solution. The buffers used may be 50 mM dimethylhexylammonium acetate with 10% $CH_3CN$ (acetonitrile) as buffer A and 50 mM dimethylhexylammonium acetate with 75% $CH_3CN$ as buffer B (gradient 25-75% buffer B over 5 mins), with a flow rate of 0.5 mL/min at 60° C. ESI-LCMS data for the chemically modified TREMs may be acquired on a Thermo Ultimate 3000-LTQ-XL mass spectrometer.

Tables 15-22 below describe a series of singly and multiply modified TREMs synthesized according to the protocol outlined in Example 1. The calculated and detected molecular weights for each sequence were determined as outlined herein.

Example 8: Analysis of Modified TREMs Via Anion-Exchange HPLC

This example describes the quality control of a synthesized TREM via anion-exchange HPLC. Using the Dionex DNA-Pac-PA-100 column, a gradient is employed using HPLC buffer A and HPLC buffer B. 0.5 ODUs of a sample that has been dissolved in H2O or Tris buffer, pH 7.5 is injected onto the gradient. The gradient employed is based on oligonucleotide length and can be applied according to Table 13. The parameters provided in Table 14 can be used to program a linear gradient on the HPLC analyzer.

TABLE 13

Oligonucleotide length and gradient percentages

| Length (bases) | Gradient (% B) |
|---|---|
| 0-5 | 0-30 |
| 6-10 | 10-40 |
| 11-16 | 20-50 |
| 17-32 | 30-60 |
| 33-50 | 40-70 |
| >50 | 50-80 |

TABLE 14

Parameters for a linear gradient on HPLC analyzer

| Time (min) | Flow (mL/min) | % Buffer A | % Buffer B |
|---|---|---|---|
| 0 | 1.5 | 100 | 0 |
| 1 | 1.5 | 100 | 0 |
| 3 | 1.5 | 70a | 30a |
| 15 | 1.5 | 40a | 60a |
| 15.5 | 2.5 | 0 | 100 |
| 17 | 2.5 | 0 | 100 |
| 17.25 | 2.5 | 100 | 0 |
| 23 | 2.5 | 100 | 0 |
| s23.1 | 1.5 | 100 | 0 |
| 24 | 1.5 | 100 | 0 |
| 25 | 0.1 | 100 | 0 |

Example 9: Analysis of TREMs Via PAGE Purification and Analysis

This example describes the quality control of a synthesized TREM via PAGE Purification and Analysis. Gel purification and analysis of 2'-ACE protected RNA follows standard protocols for denaturing PAGE (Ellington and Pollard (1998) *In Current Protocols in Molecular Biology*, Chanda, V). Briefly, the 2'-ACE protected oligo is resuspended in 200 mL of gel loading buffer. Invitrogen™ NuPAGE™ 4-12% Bis-Tris Gels or similar gel is prepared in gel apparatus. Samples are loaded and gel ran at 50-120 W, maintaining the apparatus at 40° C. When complete, the gel is exposed to ultraviolet (UV) light at 254 nm to visualize the purity of the RNA using UV shadowing. If necessary, the desired gel band is excised with a clean razor blade. The gel slice is crushed and 0.3M NaOAc elution buffer is added to the gel particles, and soaked overnight. The mixture is decanted and filtered through a Sephadex column such as Nap-10 or Nap-25.

Example 10: Deprotection of Synthesized TREM

This example describes the deprotection of a TREM made according to an in vitro synthesis method. The 2'-protecting groups are removed using 100 mM acetic acid, pH 3.8. The formic acid and ethylene glycol byproducts are removed by incubating at 60° C. for 30 min followed by lyophilization or SpeedVac-ing to dryness. After this final deprotection step, the oligonucleotides are ready for use.

Example 11. Characterization of Chemically Modified TREMs for Readthrough of a Premature Termination Codon (PTC) in a Reporter Protein This example describes an assay to test the ability of a non-cognate chemically modified TREM to readthrough a PTC in a cell line expressing a reporter protein having a PTC. This Example describes analysis of chemically modified arginine, serine, and glutamine non-cognate TREM (i.e., Arg-TGA, Ser-TAG, and Gln-TAA), though a non-cognate TREM specifying any one of the other amino acids can also be used.

A cell line engineered to stably express the NanoLuc reporter construct containing a premature termination codon (PTC) may be generated using the FlpIn system according to the manufacturer's instructions. Delivery of the chemically modified TREMs into the NanoLuc reporter cells is carried out via a reverse transfection reaction using lipofectamine RNAiMAX (ThermoFisher Scientific, USA) according to manufacturer instructions. Briefly, 5 μL of a 2.5 μM solution of chemically modified TREM sample are diluted in a 20 μL RNAiMAX/OptiMEM mixture. After 30 min gentle mixing at room temperature, the 25 μL TREM/transfection mixture is added to a 96-well plate and kept still for 20-30 min before adding the cells. The NanoLuc reporter cells are harvested and diluted to 4×10⁵ cells/mL in complete growth medium, and 100 μL of the diluted cell suspension is added and mixed to the plate containing the TREM. After 24 h, 100 μL complete growth medium is added to the 96-well plate for cell health.

To monitor the efficacy of the chemically modified TREM to read through the PTC in the reporter construct 48 hours after TREM delivery into cells, a NanoGlo bioluminescent assay (Promega, USA) may be performed according to manufacturer instruction. Briefly, cell media is replaced and allowed to equilibrate to room temperature. NanoGlo reagent is prepared by mixing the buffer with substrate in a 50:1 ratio. 50 μL of mixed NanoGlo reagent is added to the 96-well plate and mixed on the shaker at 600 rpm for 10 min. After 2 min, the plate is centrifuged at 1000 g, followed by a 5 min incubation step at room temperature before measuring sample bioluminescence. As a positive control, a host cell expressing the NanoLuc reporter construct without a PTC is used. As a negative control, a host cell expressing the NanoLuc reporter construct with a PTC is used, but no TREM is transfected. The efficacy of the chemically modified TREMs are measured as a ratio of the NanoLuc luminescence in the experimental sample to the NanoLuc luminescence of the positive control or as a ratio of the NanoLuc luminescence in the experimental sample to the NanoLuc luminescence of the negative control. It is expected that if the sample TREM is functional, it may be able to read-through the stop mutation in the NanoLuc reporter and produce a luminescent reading higher than the luminescent reading measured in the negative control. If the sample TREM is not functional, the stop mutation is not rescued, and luminescence less or equal to the negative control is detected.

The impacts of chemical modification type and position were evaluated in singly and multiply modified TREM sequences as outlined in Table 15-22 below. Tables 15-19 describe the activity of an exemplary chemically modified TREM-Arg-TGA sequence, in which 2'-OMe (Table 15), 2'-F (Table 16), 2'-MOE (Table 17), 2'-deoxy (Table 18), and PS (Table 19) modifications were installed at every position in the TREM sequence. Additional TREM sequences were also modified at every position with a 2'-OMe modification, namely Ser-TAG (Table 20) and Gln-TAA (Table 21). In addition, a selection of multiply modified TREM sequences were prepared according to Examples 1 and 9 and tested as outlined herein; these data are summarized in Table 22. In these tables, the sequences are annotated as follows: r: ribonucleotide; m: 2'-OMe; *: PS linkage; f: 2'-fluoro; moe: 2'-moe; d: deoxyribonucleotide; 5MeC: 5-methylcytosine. Thus, for example, mA represents 2'-O-methyl adenosine, moe5MeC represents 2'-MOE nucleotide with 5-methylcytosine nucleobase, and dA represents an adenosine deoxyribonucleotide.

In addition, in these tables, the results of the activity screen are reported as log 2 fold changes compared with the appropriate unmodified TREM, wherein "1" indicates less than a −0.05 log 2 fold change; "2" indicates greater than or equal to −0.05 and less than 0.55 log 2 fold change; and "3" indicates greater than or equal to 0.55 log 2 fold change. The results for the all the singly modified TREM-Arg-TGA screens is compared in FIG. 1. The results show that certain modifications were tolerated at many positions, but particular sites were sensitive to modification or exhibited improved activity when modified. For example, neither 2'-OMe and 2'-MOE were tolerated at positions 33 in the Arg-TGA sequence, yet 2'-F and 2'-deoxy (DNA) improved the activity at positions 33. 2'OMe was particularly active at positions 1 and 73. 2'-deoxy (DNA) was also well tolerated at position 31. PS modification improved activity when incorporated in-between positions 35 and 36, in-between 37 and 38, in-between 38 and 39, in-between 54 and 55, and in-between positions 55 and 56.

TABLE 15

| SEQ ID NO. | Mod | Sequence | Calculated MW | Detected MW | Results |
|---|---|---|---|---|---|
| 622 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24509.24 | 24508 | 2 |
| 623 | OME 1 | mGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24526.4 | 3 |
| 624 | OME 2 | rGmGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24516.6 | 3 |
| 625 | OME 3 | rGrGmCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr | 24523.24 | 24526.6 | 2 |

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| | | GrUrUrCrGrArGrUrCrCrCrGrGrC rGrGrArGrUrCrGrCrCrA | | | |
| 626 | OME 4 | rGrGrCmUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24517.6 | 3 |
| 627 | OME 5 | rGrGrCrUmCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24516.5 | 2 |
| 628 | OME 6 | rGrGrCrUrCmCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24511 | 3 |
| 629 | OME 7 | rGrGrCrUrCrCmGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24516.5 | 1 |
| 630 | OME 8 | rGrGrCrUrCrCrGmUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24511.6 | 1 |
| 631 | OME 9 | rGrGrCrUrCrCrGrUmGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24514.9 | 1 |
| 632 | OME 10 | rGrGrCrUrCrCrGrUrGmGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24535.3 | 3 |
| 633 | OME 11 | rGrGrCrUrCrCrGrUrGrGmCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24532.9 | 2 |
| 634 | OME 12 | rGrGrCrUrCrCrGrUrGrGrCmGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24530.5 | 3 |
| 635 | OME 13 | rGrGrCrUrCrCrGrUrGrGrCrGmCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.9 | 3 |
| 636 | OME 14 | rGrGrCrUrCrCrGrUrGrGrCrGrCm ArArUrGrGrArUrArGrCrGrCrAr | 24523.24 | 24530 | 2 |

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| | | UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | | | |
| 637 | OME 15 | rGrGrCrUrCrCrGrUrGrGrCrGrCr AmArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24531.3 | 2 |
| 638 | OME 16 | rGrGrCrUrCrCrGrUrGrGrCrGrCr ArAmUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24530.2 | 2 |
| 639 | OME 17 | rGrGrCrUrCrCrGrUrGrGrCrGrCr ArArUmGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24530 | 3 |
| 640 | OME 18 | rGrGrCrUrCrCrGrUrGrGrCrGrCr ArArUrGmGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24530.3 | 3 |
| 641 | OME 19 | rGrGrCrUrCrCrGrUrGrGrCrGrCr ArArUrGrGmArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24531 | 1 |
| 642 | OME 20 | rGrGrCrUrCrCrGrUrGrGrCrGrCr ArArUrGrGrAmUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24531.5 | 3 |
| 643 | OME 21 | rGrGrCrUrCrCrGrUrGrGrGrCrGrCr ArArUrGrGrArUmGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24521.2 | 1 |
| 644 | OME 22 | rGrGrCrUrCrCrGrUrGrGrCrGrCr ArArUrGrGrArUrAmGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.8 | 3 |
| 645 | OME 23 | rGrGrCrUrCrCrGrUrGrGrCrGrCr ArArUrGrGrArUrArGmCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.9 | 2 |
| 646 | OME 24 | rGrGrCrUrCrCrGrUrGrGrCrGrCr ArArUrGrGrArUrArGrCmGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.7 | 2 |

TABLE 15-continued

| | | 2'OMe-Modified TREMs (TREM-Arg-TGA) and related data | | | |
|---|---|---|---|---|---|
| SEQ ID NO. | Mod | Sequence | Calculated MW | Detected MW | Results |
| 647 | OME 25 | rGrGrCrUrCrCrGrUrGrGrCrGrCr ArArUrGrGrArUrArGrCrGmCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.9 | 2 |
| 648 | OME 26 | rGrGrCrUrCrCrGrUrGrGrCrGrCr ArArUrGrGrArUrArGrCrGrCmAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.3 | 1 |
| 649 | OME 27 | rGrGrCrUrCrCrGrUrGrGrCrGrCr ArArUrGrGrArUrArGrCrGrCrAm UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24529.7 | 2 |
| 650 | OME 28 | rGrGrCrUrCrCrGrUrGrGrCrGrCr ArArUrGrGrArUrArGrCrGrCrAr UmUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.21 | 24529.9 | 2 |
| 651 | OME 29 | rGrGrCrUrCrCrGrUrGrGrCrGrCr ArArUrGrGrArUrArGrCrGrCrAr UrUmGrGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.8 | 3 |
| 652 | OME 30 | rGrGrCrUrCrCrGrUrGrGrCrGrCr ArArUrGrGrArUrArGrCrGrCrAr UrUrGmGrArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24530 | 3 |
| 653 | OME 31 | rGrGrCrUrCrCrGrUrGrGrCrGrCr ArArUrGrGrArUrArGrCrGrCrAr UrUrGrGmArCrUrUrCrArArArUr UrCrArArArGrGrUrUrCrCrGrGr GrUrUrCrGrArGrUrCrCrCrGrGrC rGrGrArGrUrCrGrCrCrA | 24523.24 | 24529.8 | 1 |
| 654 | OME 32 | rGrGrCrUrCrCrGrUrGrGrCrGrCr ArArUrGrGrArUrArGrCrGrCrAr UrUrGrGrAmCrUrUrCrArArArUr UrCrArArArGrGrUrUrCrCrGrGr GrUrUrCrGrArGrUrCrCrCrGrGrC rGrGrArGrUrCrGrCrCrA | 24522.68 | 24524.9 | 1 |
| 655 | OME 33 | rGrGrCrUrCrCrGrUrGrGrCrGrCr ArArUrGrGrArUrArGrCrGrCrAr UrUrGrGrArCmUrUrCrArArArUr UrCrArArArGrGrUrUrCrCrGrGr GrUrUrCrGrArGrUrCrCrCrGrGrC rGrGrArGrUrCrGrCrCrA | 24523.21 | 24529.9 | 1 |
| 656 | OME 34 | rGrGrCrUrCrCrGrUrGrGrCrGrCr ArArUrGrGrArUrArGrCrGrCrAr UrUrGrGrArCrUmUrCrArArArUr UrCrArArArGrGrUrUrCrCrGrGr GrUrUrCrGrArGrUrCrCrCrGrGrC rGrGrArGrUrCrGrCrCrA | 24523.21 | 24529.8 | 1 |

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| 657 | OME 35 | rGrGrCrUrCrCrGrUrGrGrCrGrCr ArArUrGrGrArUrArGrCrGrCrAr UrUrGrGrArCrUrUmCrArArArUr UrCrArArArGrGrUrUrCrCrGrGr GrUrUrCrGrArGrUrCrCrCrGrGrC rGrGrArGrUrCrGrCrCrA | 24522.68 | 24530 | 1 |
| 658 | OME 36 | rGrGrCrUrCrCrGrUrGrGrCrGrCr ArArUrGrGrArUrArGrCrGrCrAr UrUrGrGrArCrUrUrCmArArArUr UrCrArArArGrGrUrUrCrCrGrGr GrUrUrCrGrArGrUrCrCrCrGrGrC rGrGrArGrUrCrGrCrCrA | 24523.24 | 24529.8 | 1 |
| 659 | OME 37 | rGrGrCrUrCrCrGrUrGrGrCrGrCr ArArUrGrGrArUrArGrCrGrCrAr UrUrGrGrArCrUrUrCrAmArArUr UrCrArArArGrGrUrUrCrCrGrGr GrUrUrCrGrArGrUrCrCrCrGrGrC rGrGrArGrUrCrGrCrCrA | 24523.24 | 24530 | 1 |
| 660 | OME 38 | rGrGrCrUrCrCrGrUrGrGrCrGrCr ArArUrGrGrArUrArGrCrGrCrAr UrUrGrGrArCrUrUrCrArAmArUr UrCrArArArGrGrUrUrCrCrGrGr GrUrUrCrGrArGrUrCrCrCrGrGrC rGrGrArGrUrCrGrCrCrA | 24523.24 | 24529.7 | 1 |
| 661 | OME 39 | rGrGrCrUrCrCrGrUrGrGrCrGrCr ArArUrGrGrArUrArGrCrGrCrAr UrUrGrGrArCrUrUrCrArArAmUr UrCrArArArGrGrUrUrCrCrGrGr GrUrUrCrGrArGrUrCrCrCrGrGrC rGrGrArGrUrCrGrCrCrA | 24523.21 | 24529.7 | 1 |
| 662 | OME 40 | rGrGrCrUrCrCrGrUrGrGrCrGrCr ArArUrGrGrArUrArGrCrGrCrAr UrUrGrGrArCrUrUrCrArArArUm UrCrArArArGrGrUrUrCrCrGrGr GrUrUrCrGrArGrUrCrCrCrGrGrC rGrGrArGrUrCrGrCrCrA | 24523.21 | 24529.5 | 1 |
| 663 | OME 41 | rGrGrCrUrCrCrGrUrGrGrCrGrCr ArArUrGrGrArUrArGrCrGrCrAr UrUrGrGrArCrUrUrCrArArArUr UmCrArArArGrGrUrUrCrCrGrGr GrUrUrCrGrArGrUrCrCrCrGrGrC rGrGrArGrUrCrGrCrCrA | 24523.24 | 24531.3 | 2 |
| 664 | OME 42 | rGrGrCrUrCrCrGrUrGrGrCrGrCr ArArUrGrGrArUrArGrCrGrCrAr UrUrGrGrArCrUrUrCrArArArUr UrCmArArArGrGrUrUrCrCrGrGr GrUrUrCrGrArGrUrCrCrCrGrGrC rGrGrArGrUrCrGrCrCrA | 24523.24 | 24529.9 | 3 |
| 665 | OME 43 | rGrGrCrUrCrCrGrUrGrGrCrGrCr ArArUrGrGrArUrArGrCrGrCrAr UrUrGrGrArCrUrUrCrArArArUr UrCrAmArArGrGrUrUrCrCrGrGr GrUrUrCrGrArGrUrCrCrCrGrGrC rGrGrArGrUrCrGrCrCrA | 24523.24 | 24531.9 | 3 |
| 666 | OME 44 | rGrGrCrUrCrCrGrUrGrGrCrGrCr ArArUrGrGrArUrArGrCrGrCrAr UrUrGrGrArCrUrUrCrArArArUr UrCrArAmArGrGrUrUrCrCrGrGr GrUrUrCrGrArGrUrCrCrCrGrGrC rGrGrArGrUrCrGrCrCrA | 24523.24 | 24529.6 | 2 |

US 12,648,958 B2

199 200

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| 667 | OME 45 | rGrGrCrUrCrCrGrUrGrGrCrGrCr ArArUrGrGrArUrArGrCrGrCrAr UrUrGrGrArCrUrUrCrArArArUr UrCrArArAmGrGrUrUrCrCrGrGr GrUrUrCrGrArGrUrCrCrCrGrGrC rGrGrArGrUrCrGrCrCrA | 24523.24 | 24531 | 3 |
| 668 | OME 46 | rGrGrCrUrCrCrGrUrGrGrCrGrCr ArArUrGrGrArUrArGrCrGrCrAr UrUrGrGrArCrUrUrCrArArArUr UrCrArArArGmGrUrUrCrCrGrGr GrUrUrCrGrArGrUrCrCrCrGrGrC rGrGrArGrUrCrGrCrCrA | 24523.24 | 24531.6 | 1 |
| 669 | OME 47 | rGrGrCrUrCrCrGrUrGrGrCrGrCr ArArUrGrGrArUrArGrCrGrCrAr UrUrGrGrArCrUrUrCrArArArUr UrCrArArArGrGmUrUrCrCrGrGr GrUrUrCrGrArGrUrCrCrCrGrGrC rGrGrArGrUrCrGrCrCrA | 24523.21 | 24530.5 | 1 |
| 670 | OME 48 | rGrGrCrUrCrCrGrUrGrGrCrGrCr ArArUrGrGrArUrArGrCrGrCrAr UrUrGrGrArCrUrUrCrArArArUr UrCrArArArGrGrUmUrCrCrGrGr GrUrUrCrGrArGrUrCrCrCrGrGrC rGrGrArGrUrCrGrCrCrA | 24523.21 | 24511.6 | 2 |
| 671 | OME 49 | rGrGrCrUrCrCrGrUrGrGrCrGrCr ArArUrGrGrArUrArGrCrGrCrAr UrUrGrGrArCrUrUrCrArArArUr UrCrArArArGrGrUrUmCrGrGr GrUrUrCrGrArGrUrCrCrCrGrGrC rGrGrArGrUrCrGrCrCrA | 24523.24 | 24514.6 | 2 |
| 672 | OME 50 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCmCrGrGr GrUrUrCrGrArGrUrCrCrCrGrGrC rGrGrArGrUrCrGrCrCrA | 24523.24 | 24512.7 | 3 |
| 673 | OME 51 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCmGrGr GrUrUrCrGrArGrUrCrCrCrGrGrC rGrGrArGrUrCrGrCrCrA | 24523.24 | 24519.7 | 2 |
| 674 | OME 52 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrGmGr GrUrUrCrGrArGrUrCrCrCrGrGrC rGrGrArGrUrCrGrCrCrA | 24523.24 | 24517.3 | 3 |
| 675 | OME 53 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrGrGm GrUrUrCrGrArGrUrCrCrCrGrGrC rGrGrArGrUrCrGrCrCrA | 24523.24 | 24520.5 | 2 |
| 676 | OME 54 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GmUrUrCrGrArGrUrCrCrCrGrGr CrGrGrArGrUrCrGrCrCrA | 24523.21 | 24516.7 | 2 |

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| 677 | OME 55 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUmUrCrGrArGrUrCrCrCrGrGr CrGrGrArGrUrCrGrCrCrA | 24523.21 | 24521.6 | 1 |
| 678 | OME 56 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUmCrGrArGrUrCrCrCrGrGr CrGrGrArGrUrCrGrCrCrA | 24523.24 | 24515.3 | 3 |
| 679 | OME 57 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCmGrArGrUrCrCrCrGrGr CrGrGrArGrUrCrGrCrCrA | 24523.24 | 24523.7 | 2 |
| 680 | OME 58 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGmArGrUrCrCrCrGrGr CrGrGrArGrUrCrGrCrCrA | 24523.24 | 24516.6 | 1 |
| 681 | OME 59 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrAmGrUrCrCrCrGrGr CrGrGrArGrUrCrGrCrCrA | 24523.24 | 24532.2 | 3 |
| 682 | OME 60 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGmUrCrCrCrGrGr CrGrGrArGrUrCrGrCrCrA | 24523.21 | 24516.5 | 1 |
| 683 | OME 61 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUmCrCrCrGrGr CrGrGrArGrUrCrGrCrCrA | 24523.24 | 24520.7 | 3 |
| 684 | OME 62 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCmCrCrGrGr CrGrGrArGrUrCrGrCrCrA | 24523.24 | 24516.8 | 2 |
| 685 | OME 63 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCmCrGrGr CrGrGrArGrUrCrGrCrCrA | 24523.24 | 24523.2 | 1 |
| 686 | OME 64 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCmGrGr CrGrGrArGrUrCrGrCrCrA | 24523.24 | 24529.6 | 2 |

TABLE 15-continued

| | | 2'OMe-Modified TREMs (TREM-Arg-TGA) and related data | | | |
|---|---|---|---|---|---|
| SEQ ID NO. | Mod | Sequence | Calculated MW | Detected MW | Results |
| 687 | OME 65 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGmGr CrGrGrArGrUrCrGrCrCrA | 24523.24 | 24530.9 | 3 |
| 688 | OME 66 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGm CrGrGrArGrUrCrGrCrCrA | 24523.24 | 24523.2 | 3 |
| 689 | OME 67 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC mGrGrArGrUrCrGrCrCrA | 24523.24 | 24530 | 2 |
| 690 | OME 68 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGmGrArGrUrCrGrCrCrA | 24523.24 | 24521.2 | 3 |
| 691 | OME 69 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGmArGrUrCrGrCrCrA | 24523.24 | 24530.4 | 3 |
| 692 | OME 70 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrAmGrUrCrGrCrCrA | 24523.24 | 24521.1 | 1 |
| 693 | OME 71 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGmUrCrGrCrCrA | 24523.21 | 24530.5 | 3 |
| 694 | OME 72 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUmCrGrCrCrA | 24523.24 | 24520.2 | 3 |
| 695 | OME 73 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCmGrCrCrA | 24523.24 | 24530.6 | 3 |
| 696 | OME 74 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGmCrCrA | 24523.24 | 24519.1 | 2 |

TABLE 15-continued

2'OMe-Modified TREMs (TREM-Arg-TGA) and related data

| SEQ ID NO. | Mod | Sequence | Calculated MW | Detected MW | Results |
|---|---|---|---|---|---|
| 697 | OME 75 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCmCrA | 24523.24 | 24531.5 | 2 |
| 698 | OME 76 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCmA | 24523.24 | 24520.2 | 2 |

TABLE 16

2'F-Modified TREMs (TREM-Arg-TGA) and related data

| SEQ ID NO. | Mod | Sequence | Calculated MW | Detected MW | Results |
|---|---|---|---|---|---|
| 699 | F 1 | fGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24513.3 | 2 |
| 700 | F 2 | rGfGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24518.7 | 2 |
| 701 | F 3 | rGrGfCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24509.1 | 1 |
| 702 | F 4 | rGrGrCfUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24514 | 1 |
| 703 | F 5 | rGrGrCrUfCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24515 | 1 |
| 704 | F 6 | rGrGrCrUrCfCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24513.8 | 1 |
| 705 | F 7 | rGrGrCrUrCrCfGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24516.7 | 1 |
| 706 | F 8 | rGrGrCrUrCrCrGfUrGrGrCrGrCr ArArUrGrGrArUrArGrCrGrCrAr | 24510.68 | 24517 | 1 |

TABLE 16-continued

2'F-Modified TREMs (TREM-Arg-TGA) and related data

| SEQ ID NO. | Mod | Sequence | Calculated MW | Detected MW | Results |
|---|---|---|---|---|---|
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 707 | F 9 | rGrGrCrUrCrCrGrUfGrGrCrGrCr | 24510.67 | 24518.4 | 1 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 708 | F 10 | rGrGrCrUrCrCrGrUrGfGrCrGrCr | 24510.67 | 24518.2 | 2 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 709 | F 11 | rGrGrCrUrCrCrGrUrGrGfCrGrCr | 24510.67 | 24517.6 | 2 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 710 | F 12 | rGrGrCrUrCrCrGrUrGrGrCfGrCr | 24510.67 | 24518.1 | 2 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 711 | F 13 | rGrGrCrUrCrCrGrUrGrGrCrGfCr | 24510.67 | 24518.3 | 2 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 712 | F 14 | rGrGrCrUrCrCrGrUrGrGrCrGrCf | 24510.68 | 24518.1 | 2 |
| | | ArArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 713 | F 15 | rGrGrCrUrCrCrGrUrGrGrCrGrCr | 24510.68 | 24519.2 | 2 |
| | | AfArUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 714 | F 16 | rGrGrCrUrCrCrGrUrGrGrCrGrCr | 24510.68 | 24518.5 | 2 |
| | | ArAfUrGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 715 | F 17 | rGrGrCrUrCrCrGrUrGrGrCrGrCr | 24510.67 | 24519.3 | 1 |
| | | ArArUfGrGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |
| 716 | F 18 | rGrGrCrUrCrCrGrUrGrGrCrGrCr | 24510.67 | 24518.6 | 2 |
| | | ArArUrGfGrArUrArGrCrGrCrAr | | | |
| | | UrUrGrGrArCrUrUrCrArArArUr | | | |
| | | UrCrArArArGrGrUrUrCrCrGrGr | | | |
| | | GrUrUrCrGrArGrUrCrCrCrGrGrC | | | |
| | | rGrGrArGrUrCrGrCrCrA | | | |

TABLE 16-continued

| | | 2'F-Modified TREMs (TREM-Arg-TGA) and related data | | | |
|---|---|---|---|---|---|
| SEQ ID NO. | Mod | Sequence | Calculated MW | Detected MW | Results |
| 717 | F 19 | rGrGrCrUrCrCrGrUrGrGrCrGrCr ArArUrGrGfArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24517.5 | 2 |
| 718 | F 20 | rGrGrCrUrCrCrGrUrGrGrGrCrGrCr ArArUrGrGrAfUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24518.4 | 3 |
| 719 | F 21 | rGrGrCrUrCrCrGrUrGrGrGrCrGrCr ArArUrGrGrArUfArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24519 | 1 |
| 720 | F 22 | rGrGrCrUrCrCrGrUrGrGrGrCrGrCr ArArUrGrGrArUrAfGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24517.5 | 2 |
| 721 | F 23 | rGrGrCrUrCrCrGrUrGrGrGrCrGrCr ArArUrGrGrArUrArGfCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24517.2 | 2 |
| 722 | F 24 | rGrGrCrUrCrCrGrUrGrGrGrCrGrCr ArArUrGrGrArUrArGrCfGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24519.3 | 1 |
| 723 | F 25 | rGrGrCrUrCrCrGrUrGrGrGrCrGrCr ArArUrGrGrArUrArGrCrGfCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24518.6 | 2 |
| 724 | F 26 | rGrGrCrUrCrCrGrUrGrGrGrCrGrCr ArArUrGrGrArUrArGrCrGrCfAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24514.8 | 1 |
| 725 | F 27 | rGrGrCrUrCrCrGrUrGrGrGrCrGrCr ArArUrGrGrArUrArGrCrGrCrAf UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24519.2 | 1 |
| 726 | F 28 | rGrGrCrUrCrCrGrUrGrGrGrCrGrCr ArArUrGrGrArUrArGrCrGrCrAr UfUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24518.5 | 2 |

TABLE 16-continued

| | | 2'F-Modified TREMs (TREM-Arg-TGA) and related data | | | |
|---|---|---|---|---|---|
| SEQ ID NO. | Mod | Sequence | Calculated MW | Detected MW | Results |
| 727 | F 29 | rGrGrCrUrCrCrGrUrGrGrCrGrCr ArArUrGrGrArUrArGrCrGrCrAr UrUfGrGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24518.3 | 3 |
| 728 | F 30 | rGrGrCrUrCrCrGrUrGrGrCrGrCr ArArUrGrGrArUrArGrCrGrCrAr UrUrGfGrArCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24517.9 | 2 |
| 729 | F 31 | rGrGrCrUrCrCrGrUrGrGrGrCrGrCr ArArUrGrGrArUrArGrCrGrCrAr UrUrGrGfArCrUrUrCrArArArUr UrCrArArArGrGrUrUrCrCrGrGr GrUrUrCrGrArGrUrCrCrCrGrGrC rGrGrArGrUrCrGrCrCrA | 24510.68 | 24517.4 | 1 |
| 730 | F 32 | rGrGrCrUrCrCrGrUrGrGrCrGrCr ArArUrGrGrArUrArGrCrGrCrAr UrUrGrGrAfCrUrUrCrArArArUr UrCrArArArGrGrUrUrCrCrGrGr GrUrUrCrGrArGrUrCrCrCrGrGrC rGrGrArGrUrCrGrCrCrA | 24510.67 | 24518.1 | 1 |
| 731 | F 33 | rGrGrCrUrCrCrGrUrGrGrGrCrGrCr ArArUrGrGrArUrArGrCrGrCrAr UrUrGrGrArCfUrUrCrArArArUr UrCrArArArGrGrUrUrCrCrGrGr GrUrUrCrGrArGrUrCrCrCrGrGrC rGrGrArGrUrCrGrCrCrA | 24510.68 | 24517.7 | 3 |
| 732 | F 34 | rGrGrCrUrCrCrGrUrGrGrCrGrCr ArArUrGrGrArUrArGrCrGrCrAr UrUrGrGrArCrUfUrCrArArArUr UrCrArArArGrGrUrUrCrCrGrGr GrUrUrCrGrArGrUrCrCrCrGrGrC rGrGrArGrUrCrGrCrCrA | 24510.68 | 24518.8 | 1 |
| 733 | F 35 | rGrGrCrUrCrCrGrUrGrGrCrGrCr ArArUrGrGrArUrArGrCrGrCrAr UrUrGrGrArCrUrUfCrArArArUr UrCrArArArGrGrUrUrCrCrGrGr GrUrUrCrGrArGrUrCrCrCrGrGrC rGrGrArGrUrCrGrCrCrA | 24510.67 | 24519 | 1 |
| 734 | F 36 | rGrGrCrUrCrCrGrUrGrGrCrGrCr ArArUrGrGrArUrArGrCrGrCrAr UrUrGrGrArCrUrUrCfArArArUr UrCrArArArGrGrUrUrCrCrGrGr GrUrUrCrGrArGrUrCrCrCrGrGrC rGrGrArGrUrCrGrCrCrA | 24510.68 | 24518.7 | 1 |
| 735 | F 37 | rGrGrCrUrCrCrGrUrGrGrCrGrCr ArArUrGrGrArUrArGrCrGrCrAr UrUrGrGrArCrUrUrCrAfArArUr UrCrArArArGrGrUrUrCrCrGrGr GrUrUrCrGrArGrUrCrCrCrGrGrC rGrGrArGrUrCrGrCrCrA | 24510.68 | 24517.6 | 1 |
| 736 | F 38 | rGrGrCrUrCrCrGrUrGrGrCrGrCr ArArUrGrGrArUrArGrCrGrCrAr UrUrGrGrArCrUrUrCrArAfArUr UrCrArArArGrGrUrUrCrCrGrGr GrUrUrCrGrArGrUrCrCrCrGrGrC rGrGrArGrUrCrGrCrCrA | 24510.68 | 24518.4 | 1 |

TABLE 16-continued

| | | 2'F-Modified TREMs (TREM-Arg-TGA) and related data | | | |
|---|---|---|---|---|---|
| SEQ ID NO. | Mod | Sequence | Calculated MW | Detected MW | Results |
| 737 | F 39 | rGrGrCrUrCrCrGrUrGrGrCrGrCr ArArUrGrGrArUrArGrCrGrCrAr UrUrGrGrArCrUrUrCrArArAfUr UrCrArArArGrGrUrUrCrCrGrGr GrUrUrCrGrArGrUrCrCrCrGrGrC rGrGrArGrUrCrGrCrCrA | 24510.68 | 24519.8 | 1 |
| 738 | F 40 | rGrGrCrUrCrCrGrUrGrGrGrCrGrCr ArArUrGrGrArUrArGrCrGrCrAr UrUrGrGrArCrUrUrCrArArArUf UrCrArArArGrGrUrUrCrCrGrGr GrUrUrCrGrArGrUrCrCrCrGrGrC rGrGrArGrUrCrGrCrCrA | 24510.68 | 24508.1 | 3 |
| 739 | F 41 | rGrGrCrUrCrCrGrUrGrGrGrCrGrCr ArArUrGrGrArUrArGrCrGrCrAr UrUrGrGrArCrUrUrCrArArArUr UfCrArArArGrGrUrUrCrCrGrGr GrUrUrCrGrArGrUrCrCrCrGrGrC rGrGrArGrUrCrGrCrCrA | 24510.67 | 24519.7 | 3 |
| 740 | F 42 | rGrGrCrUrCrCrGrUrGrGrGrCrGrCr ArArUrGrGrArUrArGrCrGrCrAr UrUrGrGrArCrUrUrCrArArArUr UrCfArArArGrGrUrUrCrCrGrGr GrUrUrCrGrArGrUrCrCrCrGrGrC rGrGrArGrUrCrGrCrCrA | 24510.68 | 24519.8 | 2 |
| 741 | F 43 | rGrGrCrUrCrCrGrUrGrGrGrCrGrCr ArArUrGrGrArUrArGrCrGrCrAr UrUrGrGrArCrUrUrCrArArArUr UrCrAfArArGrGrUrUrCrCrGrGr GrUrUrCrGrArGrUrCrCrCrGrGrC rGrGrArGrUrCrGrCrCrA | 24510.68 | 24518.5 | 2 |
| 742 | F 44 | rGrGrCrUrCrCrGrUrGrGrGrCrGrCr ArArUrGrGrArUrArGrCrGrCrAr UrUrGrGrArCrUrUrCrArArArUr UrCrArAfArGrGrUrUrCrCrGrGr GrUrUrCrGrArGrUrCrCrCrGrGrC rGrGrArGrUrCrGrCrCrA | 24510.68 | 24519 | 3 |
| 743 | F 45 | rGrGrCrUrCrCrGrUrGrGrGrCrGrCr ArArUrGrGrArUrArGrCrGrCrAr UrUrGrGrArCrUrUrCrArArArUr UrCrArArAfGrGrUrUrCrCrGrGr GrUrUrCrGrArGrUrCrCrCrGrGrC rGrGrArGrUrCrGrCrCrA | 24510.67 | 24517.7 | 3 |
| 744 | F 46 | rGrGrCrUrCrCrGrUrGrGrGrCrGrCr ArArUrGrGrArUrArGrCrGrCrAr UrUrGrGrArCrUrUrCrArArArUr UrCrArArArGfUrUrCrCrGrGr GrUrUrCrGrArGrUrCrCrCrGrGrC rGrGrArGrUrCrGrCrCrA | 24510.67 | 24518.8 | 2 |
| 745 | F 47 | rGrGrCrUrCrCrGrUrGrGrGrCrGrCr ArArUrGrGrArUrArGrCrGrCrAr UrUrGrGrArCrUrUrCrArArArUr UrCrArArArGrGfUrUrCrCrGrGr GrUrUrCrGrArGrUrCrCrCrGrGrC rGrGrArGrUrCrGrCrCrA | 24510.68 | 24518.6 | 2 |
| 746 | F 48 | rGrGrCrUrCrCrGrUrGrGrGrCrGrCr ArArUrGrGrArUrArGrCrGrCrAr UrUrGrGrArCrUrUrCrArArArUr UrCrArArArGrGrUfUrCrCrGrGr GrUrUrCrGrArGrUrCrCrCrGrGrC rGrGrArGrUrCrGrCrCrA | 24510.68 | 24518.5 | 3 |

TABLE 16-continued

2'F-Modified TREMs (TREM-Arg-TGA) and related data

| SEQ ID NO. | Mod | Sequence | Calculated MW | Detected MW | Results |
|---|---|---|---|---|---|
| 747 | F 49 | rGrGrCrUrCrCrGrUrGrGrCrGrCr ArArUrGrGrArUrArGrCrGrCrAr UrUrGrGrArCrUrUrCrArArArUr UrCrArArArGrGrUrUfCrCrGrGr GrUrUrCrGrArGrUrCrCrCrGrGrC rGrGrArGrUrCrGrCrCrA | 24510.67 | 24519.4 | 3 |
| 748 | F 50 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCfCrGrGr GrUrUrCrGrArGrUrCrCrCrGrGrC rGrGrArGrUrCrGrCrCrA | 24510.67 | 24518.6 | 3 |
| 749 | F 51 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCfGrGr GrUrUrCrGrArGrUrCrCrCrGrGrC rGrGrArGrUrCrGrCrCrA | 24510.67 | 24518.2 | 1 |
| 750 | F 52 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGfGr GrUrUrCrGrArGrUrCrCrCrGrGrC rGrGrArGrUrCrGrCrCrA | 24510.67 | 24519.1 | 3 |
| 751 | F 53 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGf GrUrUrCrGrArGrUrCrCrCrGrGrC rGrGrArGrUrCrGrCrCrA | 24510.67 | 24518.7 | 3 |
| 752 | F 54 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GfUrUrCrGrArGrUrCrCrCrGrGrC rGrGrArGrUrCrGrCrCrA | 24510.68 | 24518.9 | 3 |
| 753 | F 55 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUfUrCrGrArGrUrCrCrCrGrGrC rGrGrArGrUrCrGrCrCrA | 24510.68 | 24520.3 | 1 |
| 754 | F 56 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUfCrGrArGrUrCrCrCrGrGrC rGrGrArGrUrCrGrCrCrA | 24510.67 | 24518.6 | 3 |
| 755 | F 57 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCfGrArGrUrCrCrCrGrGrC rGrGrArGrUrCrGrCrCrA | 24510.67 | 24518.2 | 2 |
| 756 | F 58 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGfArGrUrCrCrCrGrGrC rGrGrArGrUrCrGrCrCrA | 24510.68 | 24518 | 1 |

TABLE 16-continued

| | | 2'F-Modified TREMs (TREM-Arg-TGA) and related data | | | |
|---|---|---|---|---|---|
| SEQ ID NO. | Mod | Sequence | Calculated MW | Detected MW | Results |
| 757 | F 59 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrAfGrUrCrCrCrGrGrC rGrGrArGrUrCrGrCrCrA | 24510.67 | 24518.5 | 3 |
| 758 | F 60 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGfUrCrCrCrGrGrC rGrGrArGrUrCrGrCrCrA | 24510.68 | 24518.2 | 2 |
| 759 | F 61 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUfCrCrCrGrGrC rGrGrArGrUrCrGrCrCrA | 24510.67 | 24517.7 | 3 |
| 760 | F 62 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCfCrCrGrGrC rGrGrArGrUrCrGrCrCrA | 24510.67 | 24519.8 | 3 |
| 761 | F 63 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCfCrGrGrC rGrGrArGrUrCrGrCrCrA | 24510.67 | 24518.4 | 3 |
| 762 | F 64 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCfGrGrC rGrGrArGrUrCrGrCrCrA | 24510.67 | 24519 | 2 |
| 763 | F 65 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGfGrC rGrGrArGrUrCrGrCrCrA | 24510.67 | 24518.2 | 3 |
| 764 | F 66 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGfC rGrGrArGrUrCrGrCrCrA | 24510.67 | 24519.1 | 2 |
| 765 | F 67 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC fGrGrArGrUrCrGrCrCrA | 24510.67 | 24518.5 | 3 |
| 766 | F 68 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGfGrArGrUrCrGrCrCrA | 24510.67 | 24518.2 | 3 |

TABLE 16-continued

| SEQ ID NO. | Mod | Sequence | Calculated MW | Detected MW | Results |
|---|---|---|---|---|---|
| 767 | F 69 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGfArGrUrCrGrCrCrA | 24510.68 | 24519.4 | 3 |
| 768 | F 70 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrAfGrUrCrGrCrCrA | 24510.67 | 24518.4 | 2 |
| 769 | F 71 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGfUrCrGrCrCrA | 24510.68 | 24520.2 | 3 |
| 770 | F 72 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUfCrGrCrCrA | 24510.67 | 24518.4 | 3 |
| 771 | F 73 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCfGrCrCrA | 24510.67 | 24517.9 | 1 |
| 772 | F 74 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGfCrCrA | 24510.67 | 24518.2 | 2 |
| 773 | F 75 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCfCrA | 24510.67 | 24518.2 | 3 |
| 774 | F 76 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCfA | 24510.68 | 24518.3 | 3 |

TABLE 17

2'MOE-Modified TREMs (TREM-Arg-TGA) and related data

| SEQ ID NO. | Mod | Sequence | Calculated MW | Detected MW | Results |
|---|---|---|---|---|---|
| 775 | MOE 1 | moeGrCrUrCrCrGrUrGrGrCrGr CrArArUrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24565.5 | 3 |
| 776 | MOE 2 | rGmoeGrCrUrCrCrGrUrGrGrCrGr CrArArUrGrGrArUrArGrCrGrCr | 24566.69 | 24565.4 | 2 |

TABLE 17-continued

| | | 2'MOE-Modified TREMs (TREM-Arg-TGA) and related data | | | |
| --- | --- | --- | --- | --- | --- |
| SEQ ID NO. | Mod | Sequence | Calculated MW | Detected MW | Results |
| | | ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | | | |
| 777 | MOE 3 | rGrGmoe5MeCrUrCrCrGrUrGrGr CrGrCrArArUrGrGrArUrArGrCr GrCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24580.5 | 2 |
| 778 | MOE 4 | rGrGrCmoeTrCrCrGrUrGrGrCrGr CrArArUrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24580.69 | 24579.3 | 3 |
| 779 | MOE 5 | rGrGrCrUmoe5MeCrCrGrUrGrGr CrGrCrArArUrGrGrArUrArGrCr GrCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24579.6 | 1 |
| 780 | MOE 6 | rGrGrCrUrCmoe5MeCrGrUrGrGr CrGrCrArArUrGrGrArUrArGrCr GrCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24579.6 | 2 |
| 781 | MOE 10 | rGrGrCrUrCrCrGrUrGmoeGrCrGr CrArArUrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24568.3 | 2 |
| 782 | MOE 11 | rGrGrCrUrCrCrGrUrGrGmoe5Me CrGrCrArArUrGrGrArUrArGrCr GrCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24579 | 1 |
| 783 | MOE 12 | rGrGrCrUrCrCrGrUrGrGrCmoeGr CrArArUrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24566.6 | 2 |
| 784 | MOE 13 | rGrGrCrUrCrCrGrUrGrGrCrGmoe 5MeCrArArUrGrGrArUrArGrCrG rCrArUrUrGrGrArCrUrUrCrArAr ArUrUrCrArArArGrGrUrUrCrCr GrGrGrUrUrCrGrArGrUrCrCrCrG rGrCrGrGrArGrUrCrGrCrCrA | 24580.68 | 24580 | 2 |
| 785 | MOE 14 | rGrGrCrUrCrCrGrUrGrGrCrGrC moeArArUrGrGrArUrArGrCrGrCrA rUrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24566.69 | 24567.7 | 3 |
| 786 | MOE 15 | rGrGrCrUrCrCrGrUrGrGrCrGrCr AmoeArUrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24561.7 | 3 |

TABLE 17-continued

| | | 2'MOE-Modified TREMs (TREM-Arg-TGA) and related data | | | |
|---|---|---|---|---|---|
| SEQ ID NO. | Mod | Sequence | Calculated MW | Detected MW | Results |
| 787 | MOE 16 | rGrGrCrUrCrCrGrUrGrGrCrGrCr ArAmoeTrGrGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24580.69 | 24581.7 | 3 |
| 788 | MOE 17 | rGrGrCrUrCrCrGrUrGrGrCrGrCr ArArUmoeGrGrArUrArGrCrGrCr ArUrUrGrGrArCrUrUrCrArArAr GrGrUrUrCrGrArGrUrCrCrCrGrG rCrGrGrArGrUrCrGrCrCrA | 24566.69 | 24566.4 | 3 |
| 789 | MOE 18 | rGrGrCrUrCrCrGrUrGrGrCrGrCr ArArUrGmoeGrArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24568.6 | 2 |
| 790 | MOE 19 | rGrGrCrUrCrCrGrUrGrGrCrGrCr ArArUrGrGmoeArUrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24563.8 | 1 |
| 791 | MOE 20 | rGrGrCrUrCrCrGrUrGrGrCrGrCr ArArUrGrGrAmoeTrArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24580.69 | 24580.2 | 3 |
| 792 | MOE 21 | rGrGrCrUrCrCrGrUrGrGrCrGrCr ArArUrGrGrArUmoeArGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24565.4 | 1 |
| 793 | MOE 22 | rGrGrCrUrCrCrGrUrGrGrCrGrCr ArArUrGrGrArUrAmoeGrCrGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24566.2 | 1 |
| 794 | MOE 23 | rGrGrCrUrCrCrGrUrGrGrCrGrCr ArArUrGrGrArUrArGmoe5MeCr GrCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24579.5 | 1 |
| 795 | MOE 24 | rGrGrCrUrCrCrGrUrGrGrCrGrCr ArArUrGrGrArUrArGrCmoeGrCr ArUrUrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24567.3 | 1 |
| 796 | MOE 25 | rGrGrCrUrCrCrGrUrGrGrCrGrCr ArArUrGrGrArUrArGrCrGmoe5 MeCrArUrUrGrGrArCrUrUrCrAr ArArUrUrCrArArArGrGrUrUrCr CrGrGrGrUrUrCrGrArGrUrCrCrC rGrGrCrGrGrArGrUrCrGrCrCrA | 24580.68 | 24578.8 | 2 |
| 797 | MOE 27 | rGrGrCrUrCrCrGrUrGrGrCrGrCr ArArUrGrGrArUrArGrCrGrCrAm oeTrUrGrGrArCrUrUrCrArArArU rUrCrArArArGrGrUrUrCrCrGrGr GrUrUrCrGrArGrUrCrCrCrGrGrC rGrGrArGrUrCrGrCrCrA | 24580.69 | 24580.3 | 2 |

TABLE 17-continued

2'MOE-Modified TREMs (TREM-Arg-TGA) and related data

| SEQ ID NO. | Mod | Sequence | Calculated MW | Detected MW | Results |
|---|---|---|---|---|---|
| 798 | MOE 28 | rGrGrCrUrCrCrGrUrGrGrCrGrCr ArArUrGrGrArUrArGrCrGrCrAr UmoeTrGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24580.69 | 24582.9 | 1 |
| 799 | MOE 29 | rGrGrCrUrCrCrGrUrGrGrCrGrCr ArArUrGrGrArUrArGrCrGrCrAr UrUmoeGrGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24568.3 | 3 |
| 800 | MOE 30 | rGrGrCrUrCrCrGrUrGrGrCrGrCr ArArUrGrGrArUrArGrCrGrCrAr UrUrGmoeGrArCrUrUrCrArArAr UrUrCrArArArGrGrUrUrCrCrGr GrGrUrUrCrGrArGrUrCrCrCrGrG rCrGrGrArGrUrCrGrCrCrA | 24566.69 | 24567.7 | 2 |
| 801 | MOE 32 | rGrGrCrUrCrCrGrUrGrGrCrGrCr ArArUrGrGrArUrArGrCrGrCrAr UrUrGrAmoe5MeCrUrUrCrAr ArArUrCrArArArGrGrUrUrCr CrGrGrGrUrUrCrGrArGrUrCrCrC rGrGrCrGrGrArGrUrCrGrCrCrA | 24580.68 | 24580.4 | 1 |
| 802 | MOE 33 | rGrGrCrUrCrCrGrUrGrGrCrGrCr ArArUrGrGrArUrArGrCrGrCrAr UrUrGrGrArCmoeTrUrCrArArAr UrUrCrArArArGrGrUrUrCrCrGr GrGrUrUrCrGrArGrUrCrCrCrGrG rCrGrGrArGrUrCrGrCrCrA | 24580.69 | 24574.5 | 1 |
| 803 | MOE 34 | rGrGrCrUrCrCrGrUrGrGrCrGrCr ArArUrGrGrArUrArGrCrGrCrAr UrUrGrGrArCrUmoeTrCrArArAr UrUrCrArArArGrGrUrUrCrCrGr GrGrUrUrCrGrArGrUrCrCrCrGrG rCrGrGrArGrUrCrGrCrCrA | 24580.69 | 24581.3 | 1 |
| 804 | MOE 35 | rGrGrCrUrCrCrGrUrGrGrCrGrCr ArArUrGrGrArUrArGrCrGrCrAr UrUrGrGrArCrUrUmoe5MeCrAr ArArUrCrArArArGrGrUrUrCr CrGrGrGrUrUrCrGrArGrUrCrCrC rGrGrCrGrGrArGrUrCrGrCrCrA | 24580.68 | 24581 | 1 |
| 805 | MOE 36 | rGrGrCrUrCrCrGrUrGrGrCrGrCr ArArUrGrGrArUrArGrCrGrCrAr UrUrGrGrArCrUrUrCmoeArArAr UrUrCrArArArGrGrUrUrCrCrGr GrGrUrUrCrGrArGrUrCrCrCrGrG rCrGrGrArGrUrCrGrCrCrA | 24566.69 | 24566.6 | 1 |
| 806 | MOE 37 | rGrGrCrUrCrCrGrUrGrGrCrGrCr ArArUrGrGrArUrArGrCrGrCrAr UrUrGrGrArCrUrUrCrAmoeArAr UrUrCrArArArGrGrUrUrCrCrGr GrGrUrUrCrGrArGrUrCrCrCrGrG rCrGrGrArGrUrCrGrCrCrA | 24566.69 | 24572.4 | 1 |
| 807 | MOE 38 | rGrGrCrUrCrCrGrUrGrGrCrGrCr ArArUrGrGrArUrArGrCrGrCrAr UrUrGrGrArCrUrUrCrArAmoeAr UrUrCrArArArGrGrUrUrCrCrGr GrGrUrUrCrGrArGrUrCrCrCrGrG rCrGrGrArGrUrCrGrCrCrA | 24566.69 | 24561.6 | 1 |
| 808 | MOE 41 | rGrGrCrUrCrCrGrUrGrGrCrGrCr ArArUrGrGrArUrArGrCrGrCrAr UrUrGrGrArCrUrUrCrArArArUr Umoe5MeCrArArArArGrGrUrUrCr | 24580.68 | 24583.5 | 1 |

TABLE 17-continued

2'MOE-Modified TREMs (TREM-Arg-TGA) and related data

| SEQ ID NO. | Mod | Sequence | Calculated MW | Detected MW | Results |
|---|---|---|---|---|---|
| | | CrGrGrGrUrUrCrGrArGrUrCrCrC rGrGrCrGrGrArGrUrCrGrCrCrA | | | |
| 809 | MOE 42 | rGrGrCrUrCrCrGrUrGrGrCrGrCr ArArUrGrGrArUrArGrCrGrCrAr UrUrGrGrArCrUrUrCrArArArUr UrCmoeArArArGrGrUrUrCrCrGr GrGrUrUrCrGrArGrUrCrCrCrGrG rCrGrGrArGrUrCrGrCrCrA | 24566.69 | 24566.9 | 1 |
| 810 | MOE 43 | rGrGrCrUrCrCrGrUrGrGrCrGrCr ArArUrGrGrArUrArGrCrGrCrAr UrUrGrGrArCrUrUrCrArArArUr UrCrAmoeArArGrGrUrUrCrCrGr GrGrUrUrCrGrArGrUrCrCrCrGrG rCrGrGrArGrUrCrGrCrCrA | 24566.69 | 24566.9 | 2 |
| 811 | MOE 44 | rGrGrCrUrCrCrGrUrGrGrCrGrCr ArArUrGrGrArUrArGrCrGrCrAr UrUrGrGrArCrUrUrCrArArArUr UrCrArAmoeArGrGrUrUrCrCrGr GrGrUrUrCrGrArGrUrCrCrCrGrG rCrGrGrArGrUrCrGrCrCrA | 24566.69 | 24566.9 | 3 |
| 812 | MOE 45 | rGrGrCrUrCrCrGrUrGrGrCrGrCr ArArUrGrGrArUrArGrCrGrCrAr UrUrGrGrArCrUrUrCrArArArUr UrCrArArAmoeGrGrUrUrCrCrGr GrGrUrUrCrGrArGrUrCrCrCrGrG rCrGrGrArGrUrCrGrCrCrA | 24566.69 | 24561 | 3 |
| 813 | MOE 46 | rGrGrCrUrCrCrGrUrGrGrCrGrCr ArArUrGrGrArUrArGrCrGrCrAr UrUrGrGrArCrUrUrCrArArArUr UrCrArArArGmoeGrUrUrCrCrGr GrGrUrUrCrGrArGrUrCrCrCrGrG rCrGrGrArGrUrCrGrCrCrA | 24566.69 | 24560.1 | 1 |
| 814 | MOE 47 | rGrGrCrUrCrCrGrUrGrGrCrGrCr ArArUrGrGrArUrArGrCrGrCrAr UrUrGrGrArCrUrUrCrArArArUr UrCrArArArGrGmoeTrUrCrCrGr GrGrUrUrCrGrArGrUrCrCrCrGrG rCrGrGrArGrUrCrGrCrCrA | 24580.69 | 24575.8 | 3 |
| 815 | MOE 48 | rGrGrCrUrCrCrGrUrGrGrCrGrCr ArArUrGrGrArUrArGrCrGrCrAr UrUrGrGrArCrUrUrCrArArArUr UrCrArArArGrGrUmoeTrCrCrGr GrGrUrUrCrGrArGrUrCrCrCrGrG rCrGrGrArGrUrCrGrCrCrA | 24580.69 | 24580.5 | 1 |
| 816 | MOE 49 | rGrGrCrUrCrCrGrUrGrGrCrGrCr ArArUrGrGrArUrArGrCrGrCrAr UrUrGrGrArCrUrUrCrArArArUr UrCrArArArGrGrUrUmoe5MeCr CrGrGrGrUrUrCrGrArGrUrCrCrC rGrGrCrGrGrArGrUrCrGrCrCrA | 24580.68 | 24578.4 | 3 |
| 817 | MOE 50 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCmoe5Me CrGrGrGrUrUrCrGrArGrUrCrCrC rGrGrCrGrGrArGrUrCrGrCrCrA | 24580.68 | 24578.8 | 3 |
| 818 | MOE 51 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCmoeGr GrGrUrUrCrGrArGrUrCrCrCrGrG rCrGrGrArGrUrCrGrCrCrA | 24566.69 | 24567.5 | 1 |
| 819 | MOE 52 | rGrGrCrUrCrCrGrUrGrGrCrGrCr ArArUrGrGrArUrArGrCrGrCrAr | 24566.69 | 24567.2 | 3 |

TABLE 17-continued

| | | 2'MOE-Modified TREMs (TREM-Arg-TGA) and related data | | | |
|---|---|---|---|---|---|
| SEQ ID NO. | Mod | Sequence | Calculated MW | Detected MW | Results |
| | | UrUrGrGrArCrUrUrCrArArArUr UrCrArArArGrGrUrUrCrCrGmoe GrGrUrUrCrGrArGrUrCrCrGrG rCrGrGrArGrUrCrGrCrCrA | | | |
| 820 | MOE 53 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrG moeGrUrUrCrGrArGrUrCrCrGrG rCrGrGrArGrUrCrGrCrCrA | 24566.69 | 24566.8 | 2 |
| 821 | MOE 54 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GmoeTrUrCrGrArGrUrCrCrGrGr GrCrGrGrArGrUrCrGrCrCrA | 24580.69 | 24582.3 | 3 |
| 822 | MOE 55 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUmoeTrCrGrArGrUrCrCrGrGr GrCrGrGrArGrUrCrGrCrCrA | 24580.69 | 24575.3 | 1 |
| 823 | MOE 56 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUmoe5MeCrGrArGrUrCrCr CrGrCrGrGrArGrUrCrGrCrCrA | 24580.68 | 24581.5 | 3 |
| 824 | MOE 57 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCmoeGrArGrUrCrCrGrGr GrCrGrGrArGrUrCrGrCrCrA | 24566.69 | 24565.3 | 3 |
| 825 | MOE 58 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGmoeArGrUrCrCrGrGr GrCrGrGrArGrUrCrGrCrCrA | 24566.69 | 24570.7 | 1 |
| 826 | MOE 59 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrAmoeGrUrCrCrGrGr GrCrGrGrArGrUrCrGrCrCrA | 24566.69 | 24562.1 | 3 |
| 827 | MOE 60 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGmoeTrCrCrGrGr GrCrGrGrArGrUrCrGrCrCrA | 24580.69 | 24581 | 1 |
| 828 | MOE 61 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUmoe5MeCrCr CrGrCrGrGrArGrUrCrGrCrCrA | 24580.68 | 24579.7 | 1 |
| 829 | MOE 62 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCmoe5MeCr CrGrCrGrGrArGrUrCrGrCrCrA | 24580.68 | 24579.3 | 1 |

TABLE 17-continued

| SEQ ID NO. | Mod | Sequence | Calculated MW | Detected MW | Results |
|---|---|---|---|---|---|
| 830 | MOE 64 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCmoeGr GrCrGrGrArGrUrCrGrCrCrA | 24566.69 | 24567.3 | 1 |
| 831 | MOE 65 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGmoe GrCrGrGrArGrUrCrGrCrCrA | 24566.69 | 24563.6 | 3 |
| 832 | MOE 66 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrG moe5MeCrGrGrArGrUrCrGrCrCrA | 24580.68 | 24577.9 | 1 |
| 833 | MOE 67 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC moeGrGrArGrUrCrGrCrCrA | 24566.69 | 24566.7 | 1 |
| 834 | MOE 68 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGmoeGrArGrUrCrGrCrCrA | 24566.69 | 24567.3 | 2 |
| 835 | MOE 69 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGmoeArGrUrCrGrCrCrA | 24566.69 | 24565.9 | 1 |
| 836 | MOE 71 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGmoeTrCrGrCrCrA | 24580.69 | 24579.5 | 1 |
| 837 | MOE 72 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUmoe5MeCrGrCrCrA | 24580.68 | 24583.5 | 3 |
| 838 | MOE 73 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCmoeGrCrCrA | 24566.69 | 24569.6 | 3 |
| 839 | MOE 74 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGmoe5MeCrCrA | 24580.68 | 24580.9 | 1 |

TABLE 17-continued

| SEQ ID NO. | Mod | Sequence | Calculated MW | Detected MW | Results |
|---|---|---|---|---|---|
| | | 2'MOE-Modified TREMs (TREM-Arg-TGA) and related data | | | |
| 840 | MOE 75 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCmoe5MeCrA | 24580.68 | 24579.7 | 2 |
| 841 | MOE 76 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCmoeA | 24566.69 | 24568.2 | 2 |

TABLE 18

| SEQ ID NO. | Mod | Sequence | Calculated MW | Detected MW | Results |
|---|---|---|---|---|---|
| | | 2'-Deoxy-Modified TREMs (TREM-Arg-TGA) and related data | | | |
| 842 | DNA 1 | dGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24493.1 | 2 |
| 843 | DNA 2 | rGdGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24493 | 2 |
| 844 | DNA 3 | rGrGdCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.8 | 3 |
| 845 | DNA 4 | rGrGrCdUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24490.9 | 3 |
| 846 | DNA 5 | rGrGrCrUdCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24492.5 | 3 |
| 847 | DNA 6 | rGrGrCrUrCdCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.4 | 3 |
| 848 | DNA 7 | rGrGrCrUrCrCdGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24492.4 | 1 |
| 849 | DNA 8 | rGrGrCrUrCrCrGdUrGrGrCrGrCr ArArUrGrGrArUrArGrCrGrCrAr | 24492.69 | 24493.5 | 1 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| | | UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | | | |
| 850 | DNA 9 | rGrGrCrUrCrCrGrUdGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24491.2 | 1 |
| 851 | DNA 10 | rGrGrCrUrCrCrGrUrGdGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24491.9 | 1 |
| 852 | DNA 11 | rGrGrCrUrCrCrGrUrGrGdCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.5 | 2 |
| 853 | DNA 12 | rGrGrCrUrCrCrGrUrGrGrCdGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24491.4 | 2 |
| 854 | DNA 13 | rGrGrCrUrCrCrGrUrGrGrCrGdCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.6 | 2 |
| 855 | DNA 14 | rGrGrCrUrCrCrGrUrGrGrCrGrCd ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.4 | 3 |
| 856 | DNA 15 | rGrGrCrUrCrCrGrUrGrGrCrGrCr AdArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.3 | 3 |
| 857 | DNA 16 | rGrGrCrUrCrCrGrUrGrGrCrGrCr ArAdUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.3 | 3 |
| 858 | DNA 17 | rGrGrCrUrCrCrGrUrGrGrCrGrCr ArArUdGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.3 | 2 |
| 859 | DNA 18 | rGrGrCrUrCrCrGrUrGrGrCrGrCr ArArUrGdGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24492.7 | 2 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 860 | DNA 19 | rGrGrCrUrCrCrGrUrGrGrCrGrCr ArArUrGrGdArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.3 | 1 |
| 861 | DNA 20 | rGrGrCrUrCrCrGrUrGrGrCrGrCr ArArUrGrGrAdUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24497.8 | 3 |
| 862 | DNA 21 | rGrGrCrUrCrCrGrUrGrGrCrGrCr ArArUrGrGrArUdArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24494.8 | 1 |
| 863 | DNA 22 | rGrGrCrUrCrCrGrUrGrGrCrGrCr ArArUrGrGrArUrAdGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24491.2 | 3 |
| 864 | DNA 23 | rGrGrCrUrCrCrGrUrGrGrCrGrCr ArArUrGrGrArUrArGdCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.7 | 3 |
| 865 | DNA 24 | rGrGrCrUrCrCrGrUrGrGrCrGrCr ArArUrGrGrArUrArGrCdGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24490.7 | 1 |
| 866 | DNA 25 | rGrGrCrUrCrCrGrUrGrGrCrGrCr ArArUrGrGrArUrArGrCrGdCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24491.8 | 2 |
| 867 | DNA 26 | rGrGrCrUrCrCrGrUrGrGrCrGrCr ArArUrGrGrArUrArGrCrGrCdAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24494.3 | 2 |
| 868 | DNA 27 | rGrGrCrUrCrCrGrUrGrGrCrGrCr ArArUrGrGrArUrArGrCrGrCrAd UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24504.9 | 2 |
| 869 | DNA 28 | rGrGrCrUrCrCrGrUrGrGrCrGrCr ArArUrGrGrArUrArGrCrGrCrAr UdUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24493.8 | 1 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 870 | DNA 29 | rGrGrCrUrCrCrGrUrGrGrCrGrCr ArArUrGrGrArUrArGrCrGrCrAr UrUdGrGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24494.2 | 2 |
| 871 | DNA 30 | rGrGrCrUrCrCrGrUrGrGrCrGrCr ArArUrGrGrArUrArGrCrGrCrAr UrUrGdGrArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24492.6 | 2 |
| 872 | DNA 31 | rGrGrCrUrCrCrGrUrGrGrCrGrCr ArArUrGrGrArUrArGrCrGrCrAr UrUrGrGdArCrUrUrCrArArArUr UrCrArArArGrGrUrUrCrCrGrGr GrUrUrCrGrArGrUrCrCrCrGrGrC rGrGrArGrUrCrGrCrCrA | 24492.69 | 24492.2 | 1 |
| 873 | DNA 32 | rGrGrCrUrCrCrGrUrGrGrCrGrCr ArArUrGrGrArUrArGrCrGrCrAr UrUrGrGrAdCrUrUrCrArArArUr UrCrArArArGrGrUrUrCrCrGrGr GrUrUrCrGrArGrUrCrCrCrGrGrC rGrGrArGrUrCrGrCrCrA | 24492.71 | 24490.7 | 2 |
| 874 | DNA 33 | rGrGrCrUrCrCrGrUrGrGrCrGrCr ArArUrGrGrArUrArGrCrGrCrAr UrUrGrGrArCdUrUrCrArArArUr UrCrArArArGrGrUrUrCrCrGrGr GrUrUrCrGrArGrUrCrCrCrGrGrC rGrGrArGrUrCrGrCrCrA | 24492.69 | 24490.5 | 3 |
| 875 | DNA 34 | rGrGrCrUrCrCrGrUrGrGrCrGrCr ArArUrGrGrArUrArGrCrGrCrAr UrUrGrGrArCrUdUrCrArArArUr UrCrArArArGrGrUrUrCrCrGrGr GrUrUrCrGrArGrUrCrCrCrGrGrC rGrGrArGrUrCrGrCrCrA | 24492.69 | 24490.7 | 1 |
| 876 | DNA 35 | rGrGrCrUrCrCrGrUrGrGrCrGrCr ArArUrGrGrArUrArGrCrGrCrAr UrUrGrGrArCrUrUdCrArArArUr UrCrArArArGrGrUrUrCrCrGrGr GrUrUrCrGrArGrUrCrCrCrGrGrC rGrGrArGrUrCrGrCrCrA | 24492.71 | 24494.9 | 1 |
| 877 | DNA 36 | rGrGrCrUrCrCrGrUrGrGrCrGrCr ArArUrGrGrArUrArGrCrGrCrAr UrUrGrGrArCrUrUrCdArArArUr UrCrArArArGrGrUrUrCrCrGrGr GrUrUrCrGrArGrUrCrCrCrGrGrC rGrGrArGrUrCrGrCrCrA | 24492.69 | 24491 | 1 |
| 878 | DNA 37 | rGrGrCrUrCrCrGrUrGrGrCrGrCr ArArUrGrGrArUrArGrCrGrCrAr UrUrGrGrArCrUrUrCrAdArArUr UrCrArArArGrGrUrUrCrCrGrGr GrUrUrCrGrArGrUrCrCrCrGrGrC rGrGrArGrUrCrGrCrCrA | 24492.69 | 24495.2 | 1 |
| 879 | DNA 38 | rGrGrCrUrCrCrGrUrGrGrCrGrCr ArArUrGrGrArUrArGrCrGrCrAr UrUrGrGrArCrUrUrCrArAdArUr UrCrArArArGrGrUrUrCrCrGrGr GrUrUrCrGrArGrUrCrCrCrGrGrC rGrGrArGrUrCrGrCrCrA | 24492.69 | 24494.4 | 2 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 880 | DNA 39 | rGrGrCrUrCrCrGrUrGrGrCrGrCr ArArUrGrGrArUrArGrCrGrCrAr UrUrGrGrArCrUrUrCrArArAdUr UrCrArArArGrGrUrUrCrCrGrGr GrUrUrCrGrArGrUrCrCrCrGrGrC rGrGrArGrUrCrGrCrCrA | 24492.69 | 24490.5 | 1 |
| 881 | DNA 40 | rGrGrCrUrCrCrGrUrGrGrGrCrGrCr ArArUrGrGrArUrArGrCrGrCrAr UrUrGrGrArCrUrUrCrArArArUd UrCrArArArGrGrUrUrCrCrGrGr GrUrUrCrGrArGrUrCrCrCrGrGrC rGrGrArGrUrCrGrCrCrA | 24492.69 | 24490.2 | 2 |
| 882 | DNA 41 | rGrGrCrUrCrCrGrUrGrGrGrCrGrCr ArArUrGrGrArUrArGrCrGrCrAr UrUrGrGrArCrUrUrCrArArArUr UdCrArArArGrGrUrUrCrCrGrGr GrUrUrCrGrArGrUrCrCrCrGrGrC rGrGrArGrUrCrGrCrCrA | 24492.71 | 24494.2 | 2 |
| 883 | DNA 42 | rGrGrCrUrCrCrGrUrGrGrGrCrGrCr ArArUrGrGrArUrArGrCrGrCrAr UrUrGrGrArCrUrUrCrArArArUr UrCdArArArGrGrUrUrCrCrGrGr GrUrUrCrGrArGrUrCrCrCrGrGrC rGrGrArGrUrCrGrCrCrA | 24492.69 | 24491.6 | 2 |
| 884 | DNA 43 | rGrGrCrUrCrCrGrUrGrGrGrCrGrCr ArArUrGrGrArUrArGrCrGrCrAr UrUrGrGrArCrUrUrCrArArArUr UrCrAdArArGrGrUrUrCrCrGrGr GrUrUrCrGrArGrUrCrCrCrGrGrC rGrGrArGrUrCrGrCrCrA | 24492.69 | 24493.7 | 1 |
| 885 | DNA 44 | rGrGrCrUrCrCrGrUrGrGrGrCrGrCr ArArUrGrGrArUrArGrCrGrCrAr UrUrGrGrArCrUrUrCrArArArUr UrCrArAdArGrGrUrUrCrCrGrGr GrUrUrCrGrArGrUrCrCrCrGrGrC rGrGrArGrUrCrGrCrCrA | 24492.69 | 24491.4 | 2 |
| 886 | DNA 45 | rGrGrCrUrCrCrGrUrGrGrGrCrGrCr ArArUrGrGrArUrArGrCrGrCrAr UrUrGrGrArCrUrUrCrArArArUr UrCrArArAdGrGrUrUrCrCrGrGr GrUrUrCrGrArGrUrCrCrCrGrGrC rGrGrArGrUrCrGrCrCrA | 24492.69 | 24493.1 | 1 |
| 887 | DNA 46 | rGrGrCrUrCrCrGrUrGrGrGrCrGrCr ArArUrGrGrArUrArGrCrGrCrAr UrUrGrGrArCrUrUrCrArArArUr UrCrArArArGdGrUrUrCrCrGrGr GrUrUrCrGrArGrUrCrCrCrGrGrC rGrGrArGrUrCrGrCrCrA | 24492.69 | 24494 | 1 |
| 888 | DNA 47 | rGrGrCrUrCrCrGrUrGrGrGrCrGrCr ArArUrGrGrArUrArGrCrGrCrAr UrUrGrGrArCrUrUrCrArArArUr UrCrArArArGrGdUrUrCrCrGrGr GrUrUrCrGrArGrUrCrCrCrGrGrC rGrGrArGrUrCrGrCrCrA | 24492.69 | 24491.1 | 2 |
| 889 | DNA 48 | rGrGrCrUrCrCrGrUrGrGrGrCrGrCr ArArUrGrGrArUrArGrCrGrCrAr UrUrGrGrArCrUrUrCrArArArUr UrCrArArArGrGrUdUrCrCrGrGr GrUrUrCrGrArGrUrCrCrCrGrGrC rGrGrArGrUrCrGrCrCrA | 24492.69 | 24490 | 2 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 890 | DNA 49 | rGrGrCrUrCrCrGrUrGrGrCrGrCr ArArUrGrGrArUrArGrCrGrCrAr UrUrGrGrArCrUrUrCrArArArUr UrCrArArArGrGrUrUdCrCrGrGr GrUrCrGrArGrUrCrCrCrGrGrC rGrGrArGrUrCrGrCrCrA | 24492.71 | 24494.4 | 2 |
| 891 | DNA 50 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCdCrGrGr GrUrUrCrGrArGrUrCrCrCrGrGrC rGrGrArGrUrCrGrCrCrA | 24492.71 | 24494 | 1 |
| 892 | DNA 51 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCdGrGr GrUrUrCrGrArGrUrCrCrCrGrGrC rGrGrArGrUrCrGrCrCrA | 24492.69 | 24497.3 | 1 |
| 893 | DNA 52 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGdGr GrUrUrCrGrArGrUrCrCrCrGrGrC rGrGrArGrUrCrGrCrCrA | 24492.69 | 24491.9 | 1 |
| 894 | DNA 53 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGd GrUrUrCrGrArGrUrCrCrCrGrGrC rGrGrArGrUrCrGrCrCrA | 24492.69 | 24491.3 | 1 |
| 895 | DNA 54 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GdUrUrCrGrArGrUrCrCrCrGrGr CrGrGrArGrUrCrGrCrCrA | 24492.69 | 24489.7 | 3 |
| 896 | DNA 55 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUdUrCrGrArGrUrCrCrCrGrGr CrGrGrArGrUrCrGrCrCrA | 24492.69 | 24490.8 | 1 |
| 897 | DNA 56 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUdCrGrArGrUrCrCrCrGrGr CrGrGrArGrUrCrGrCrCrA | 24492.71 | 24493 | 2 |
| 898 | DNA 57 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCdGrArGrUrCrCrCrGrGr CrGrGrArGrUrCrGrCrCrA | 24492.69 | 24494.9 | 1 |
| 899 | DNA 58 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGdArGrUrCrCrCrGrGr CrGrGrArGrUrCrGrCrCrA | 24492.69 | 24493.4 | 2 |

US 12,648,958 B2

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 900 | DNA 59 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGdGrUrCrCrCrGrGr CrGrGrArGrUrCrGrCrCrA | 24492.69 | 24491.3 | 3 |
| 901 | DNA 60 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGdUrCrCrCrGrGr CrGrGrArGrUrCrGrCrCrA | 24492.69 | 24490.3 | 2 |
| 902 | DNA 61 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUdCrCrCrGrGr CrGrGrArGrUrCrGrCrCrA | 24492.71 | 24493.3 | 2 |
| 903 | DNA 62 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCdCrCrGrGr CrGrGrArGrUrCrGrCrCrA | 24492.71 | 24494.6 | 3 |
| 904 | DNA 63 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCdCrGrGr CrGrGrArGrUrCrGrCrCrA | 24492.71 | 24491.7 | 3 |
| 905 | DNA 64 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCdGrGr CrGrGrArGrUrCrGrCrCrA | 24492.69 | 24491.8 | 2 |
| 906 | DNA 65 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGdGr CrGrGrArGrUrCrGrCrCrA | 24492.69 | 24491.9 | 2 |
| 907 | DNA 66 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGd CrGrGrArGrUrCrGrCrCrA | 24492.71 | 24491.5 | 2 |
| 908 | DNA 67 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC dGrGrArGrUrCrGrCrCrA | 24492.69 | 24491.5 | 2 |
| 909 | DNA 68 | rGrGrCrUrCrCrGrUrGrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGdGrArGrUrCrGrCrCrA | 24492.69 | 24490.5 | 1 |

TABLE 18-continued

2'-Deoxy-Modified TREMs (TREM-Arg-TGA) and related data

| SEQ ID NO. | Mod | Sequence | Calculated MW | Detected MW | Results |
|---|---|---|---|---|---|
| 910 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGdArGrUrCrGrCrCrA | 24492.69 | 24494.2 | |
| 911 | DNA 70 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrAdGrUrCrGrCrCrA | 24492.69 | 24500.8 | 2 |
| 912 | DNA 71 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGdUrCrGrCrCrA | 24492.69 | 24491.1 | 2 |
| 913 | DNA 72 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUdCrGrCrCrA | 24492.71 | 24501.2 | 3 |
| 914 | DNA 73 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCdGrCrCrA | 24492.69 | 24501.4 | 1 |
| 915 | DNA 74 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGdCrCrA | 24492.71 | 24499.8 | 2 |
| 916 | DNA 75 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCdCrA | 24492.71 | 24501.9 | 2 |
| 917 | DNA 76 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCdA | 24492.69 | 24501.9 | 3 |

TABLE 19

Phosphorothioate-Modified TREMs (TREM-Arg-TGA) and related data

| SEQ ID NO. | Mod | Sequence | Calculated MW | Detected MW | Results |
|---|---|---|---|---|---|
| 918 | PS 1 | rG*rGrCrUrCrCrGrUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24525.3 | 24528.7 | 3 |
| 919 | PS 2 | rGrG*rCrUrCrCrGrUrGrGrCrGrC rArArUrGrGrArUrArGrCrGrCrAr | 24525.3 | 24532.7 | 3 |

US 12,648,958 B2

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| | | UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | | | |
| 920 | PS 3 | rGrGrC*rUrCrCrGrUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24525.3 | 24521.1 | 3 |
| 921 | | rGrGrCrU*rCrCrGrUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24532.3 | |
| 922 | | rGrGrCrUrC*rCrGrUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24532.4 | |
| 923 | PS 6 | rGrGrCrUrCrC*rGrUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24529.8 | 1 |
| 924 | | rGrGrCrUrCrCrG*rUrGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.4 | |
| 925 | PS 8 | rGrGrCrUrCrCrGrU*rGrGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24529.8 | 1 |
| 926 | PS 9 | rGrGrCrUrCrCrGrUrG*rGrCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24531.1 | 3 |
| 927 | PS 10 | rGrGrCrUrCrCrGrUrGrG*rCrGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24529.8 | 2 |
| 928 | PS 11 | rGrGrCrUrCrCrGrUrGrGrC*rGrC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24532.4 | 1 |
| 929 | PS 12 | rGrGrCrUrCrCrGrUrGrGrCrG*rC rArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24531.2 | 1 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 930 | PS 13 | rGrGrCrUrCrCrGrUrGrGrCrGrC*rArArUrGrGrArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24529.9 | 1 |
| 931 | PS 14 | rGrGrCrUrCrCrGrUrGrGrCrGrCrA*rArUrGrGrArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 932 | PS 15 | rGrGrCrUrCrCrGrUrGrGrCrGrCrArA*rUrGrGrArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24531.5 | 3 |
| 933 | PS 16 | rGrGrCrUrCrCrGrUrGrGrCrGrCrArArU*rGrGrArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 934 | PS 17 | rGrGrCrUrCrCrGrUrGrGrCrGrCrArArUrG*rGrArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 935 | PS 18 | rGrGrCrUrCrCrGrUrGrGrCrGrCrArArUrGrG*rArUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 936 | PS 19 | rGrGrCrUrCrCrGrUrGrGrCrGrCrArArUrGrGrA*rUrArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24525.3 | 24519.6 | 3 |
| 937 | PS 20 | rGrGrCrUrCrCrGrUrGrGrCrGrCrArArUrGrGrArU*rArGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 938 | PS 21 | rGrGrCrUrCrCrGrUrGrGrCrGrCrArArUrGrGrArUrA*rGrCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24530 | 3 |
| 939 | PS 22 | rGrGrCrUrCrCrGrUrGrGrCrGrCrArArUrGrGrArUrArG*rCrGrCrArUrUrGrGrArCrUrUrCrArArArUrUrCrArArArGrGrUrUrCrCrGrGrGrUrUrCrGrArGrUrCrCrCrGrGrCrGrGrArGrUrCrGrCrCrA | 24524.68 | 24531.5 | 2 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 940 | | rGrGrCrUrCrCrGrUrGrGrCrGrCr ArArUrGrGrArUrArGrC*rGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.5 | |
| 941 | PS 24 | rGrGrCrUrCrCrGrUrGrGrGrCrGrCr ArArUrGrGrArUrArGrCrG*rCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24531.9 | 2 |
| 942 | PS 25 | rGrGrCrUrCrCrGrUrGrGrGrCrGrCr ArArUrGrGrArUrArGrCrGrC*rAr UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24528.8 | 2 |
| 943 | PS 26 | rGrGrCrUrCrCrGrUrGrGrGrCrGrCr ArArUrGrGrArUrArGrCrGrGrCrA*r UrUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24531.4 | 2 |
| 944 | PS 27 | rGrGrCrUrCrCrGrUrGrGrGrCrGrCr ArArUrGrGrArUrArGrCrGrGrCrAr U*rUrGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.8 | 2 |
| 945 | PS 28 | rGrGrCrUrCrCrGrUrGrGrGrCrGrCr ArArUrGrGrArUrArGrCrGrGrCrAr UrU*rGrGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.4 | 1 |
| 946 | PS 29 | rGrGrCrUrCrCrGrUrGrGrGrCrGrCr ArArUrGrGrArUrArGrCrGrGrCrAr UrUrG*rGrArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.6 | 2 |
| 947 | PS 30 | rGrGrCrUrCrCrGrUrGrGrGrCrGrCr ArArUrGrGrArUrArGrCrGrGrCrAr UrUrGrG*rArCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24530.6 | 2 |
| 948 | PS 31 | rGrGrCrUrCrCrGrUrGrGrGrCrGrCr ArArUrGrGrArUrArGrCrGrGrCrAr UrUrGrGrA*rCrUrUrCrArArArUr UrCrArArArGrGrUrUrCrCrGrGr GrUrUrCrGrArGrUrCrCrCrGrGrC rGrGrArGrUrCrGrCrCrA | 24524.68 | 24529.3 | 2 |
| 949 | PS 32 | rGrGrCrUrCrCrGrUrGrGrGrCrGrCr ArArUrGrGrArUrArGrCrGrGrCrAr UrUrGrGrArC*rUrUrCrArArArUr UrCrArArArGrGrUrUrCrCrGrGr GrUrUrCrGrArGrUrCrCrCrGrGrC rGrGrArGrUrCrGrCrCrA | 24524.68 | 24523.9 | 1 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 950 | PS 33 | rGrGrCrUrCrCrGrUrGrGrCrGrCr ArArUrGrGrArUrArGrCrGrCrAr UrUrGrGrArCrU*rUrCrArArArUr UrCrArArArGrGrUrUrCrCrGrGr GrUrUrCrGrArGrUrCrCrCrGrGrC rGrGrArGrUrCrGrCrCrA | 24524.68 | 24518.8 | 2 |
| 951 | PS 34 | rGrGrCrUrCrCrGrUrGrGrCrGrCr ArArUrGrGrArUrArGrCrGrCrAr UrUrGrGrArCrUrU*rCrArArArUr UrCrArArArGrGrUrUrCrCrGrGr GrUrUrCrGrArGrUrCrCrCrGrGrC rGrGrArGrUrCrGrCrCrA | 24524.68 | 24524.9 | 1 |
| 952 | PS 35 | rGrGrCrUrCrCrGrUrGrGrCrGrCr ArArUrGrGrArUrArGrCrGrCrAr UrUrGrGrArCrUrUrC*rArArArUr UrCrArArArGrGrUrUrCrCrGrGr GrUrUrCrGrArGrUrCrCrCrGrGrC rGrGrArGrUrCrGrCrCrA | 24524.68 | 24524.8 | 3 |
| 953 | PS 36 | rGrGrCrUrCrCrGrUrGrGrCrGrCr ArArUrGrGrArUrArGrCrGrCrAr UrUrGrGrArCrUrUrCrA*rArArUr UrCrArArArGrGrUrUrCrCrGrGr GrUrUrCrGrArGrUrCrCrCrGrGrC rGrGrArGrUrCrGrCrCrA | 24524.68 | 24518.4 | 1 |
| 954 | PS 37 | rGrGrCrUrCrCrGrUrGrGrCrGrCr ArArUrGrGrArUrArGrCrGrCrAr UrUrGrGrArCrUrUrCrArA*rArUr UrCrArArArGrGrUrUrCrCrGrGr GrUrUrCrGrArGrUrCrCrCrGrGrC rGrGrArGrUrCrGrCrCrA | 24524.68 | 24524.7 | 3 |
| 955 | PS 38 | rGrGrCrUrCrCrGrUrGrGrCrGrCr ArArUrGrGrArUrArGrCrGrCrAr UrUrGrGrArCrUrUrCrArArA*rUr UrCrArArArGrGrUrUrCrCrGrGr GrUrUrCrGrArGrUrCrCrCrGrGrC rGrGrArGrUrCrGrCrCrA | 24524.68 | 24519.4 | 3 |
| 956 | PS 39 | rGrGrCrUrCrCrGrUrGrGrCrGrCr ArArUrGrGrArUrArGrCrGrCrAr UrUrGrGrArCrUrUrCrArArArU*r UrCrArArArGrGrUrUrCrCrGrGr GrUrUrCrGrArGrUrCrCrCrGrGrC rGrGrArGrUrCrGrCrCrA | 24524.68 | 24529.7 | 1 |
| 957 | | rGrGrCrUrCrCrGrUrGrGrCrGrCr ArArUrGrGrArUrArGrCrGrCrAr UrUrGrGrArCrUrUrCrArArArUr U*rCrArArArGrGrUrUrCrCrGrGr GrUrUrCrGrArGrUrCrCrCrGrGrC rGrGrArGrUrCrGrCrCrA | 24524.68 | 24529.8 | |
| 958 | PS 41 | rGrGrCrUrCrCrGrUrGrGrCrGrCr ArArUrGrGrArUrArGrCrGrCrAr UrUrGrGrArCrUrUrCrArArArUr UrC*rArArArGrGrUrUrCrCrGrGr GrUrUrCrGrArGrUrCrCrCrGrGrC rGrGrArGrUrCrGrCrCrA | 24524.68 | 24529.9 | 2 |
| 959 | | rGrGrCrUrCrCrGrUrGrGrCrGrCr ArArUrGrGrArUrArGrCrGrCrAr UrUrGrGrArCrUrUrCrArArArUr UrCrA*rArArGrGrUrUrCrCrGrGr GrUrUrCrGrArGrUrCrCrCrGrGrC rGrGrArGrUrCrGrCrCrA | 24524.68 | 24530.8 | |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 960 | PS 43 | rGrGrCrUrCrCrGrUrGrGrCrGrCr ArArUrGrGrArUrArGrCrGrCrAr UrUrGrGrArCrUrUrCrArArArUr UrCrArA*rArGrGrUrUrCrCrGrGr GrUrUrCrGrArGrUrCrCrCrGrGrC rGrGrArGrUrCrGrCrCrA | 24524.68 | 24529.4 | 2 |
| 961 | PS 44 | rGrGrCrUrCrCrGrUrGrGrCrGrCr ArArUrGrGrArUrArGrCrGrCrAr UrUrGrGrArCrUrUrCrArArArUr UrCrArArA*rGrGrUrUrCrCrGrGr GrUrUrCrGrArGrUrCrCrCrGrGrC rGrGrArGrUrCrGrCrCrA | 24524.68 | 24518.4 | 3 |
| 962 | PS 45 | rGrGrCrUrCrCrGrUrGrGrCrGrCr ArArUrGrGrArUrArGrCrGrCrAr UrUrGrGrArCrUrUrCrArArArUr UrCrArArArG*rGrUrUrCrCrGrGr GrUrUrCrGrArGrUrCrCrCrGrGrC rGrGrArGrUrCrGrCrCrA | 24524.68 | 24529.7 | 3 |
| 963 | PS 46 | rGrGrCrUrCrCrGrUrGrGrCrGrCr ArArUrGrGrArUrArGrCrGrCrAr UrUrGrGrArCrUrUrCrArArArUr UrCrArArArGrG*rUrUrCrCrGrGr GrUrUrCrGrArGrUrCrCrCrGrGrC rGrGrArGrUrCrGrCrCrA | 24524.68 | 24520.2 | 3 |
| 964 | PS 47 | rGrGrCrUrCrCrGrUrGrGrCrGrCr ArArUrGrGrArUrArGrCrGrCrAr UrUrGrGrArCrUrUrCrArArArUr UrCrArArArGrGrU*rUrCrCrGrGr GrUrUrCrGrArGrUrCrCrCrGrGrC rGrGrArGrUrCrGrCrCrA | 24524.68 | 24528.3 | 2 |
| 965 | PS 48 | rGrGrCrUrCrCrGrUrGrGrCrGrCr ArArUrGrGrArUrArGrCrGrCrAr UrUrGrGrArCrUrUrCrArArArUr UrCrArArArGrGrUrU*rCrCrGrGr GrUrUrCrGrArGrUrCrCrCrGrGrC rGrGrArGrUrCrGrCrCrA | 24524.68 | 24518.7 | 1 |
| 966 | PS 49 | rGrGrCrUrCrCrGrUrGrGrCrGrCr ArArUrGrGrArUrArGrCrGrCrAr UrUrGrGrArCrUrUrCrArArArUr UrCrArArArGrGrUrUrC*rCrGrGr GrUrUrCrGrArGrUrCrCrCrGrGrC rGrGrArGrUrCrGrCrCrA | 24524.68 | 24529.6 | 2 |
| 967 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrC*rGrGr GrUrUrCrGrArGrUrCrCrCrGrGrC rGrGrArGrUrCrGrCrCrA | 24524.68 | 24530.4 | |
| 968 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrG*rGr GrUrUrCrGrArGrUrCrCrCrGrGrC rGrGrArGrUrCrGrCrCrA | 24524.68 | 24528.8 | |
| 969 | PS 52 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrG*r GrUrUrCrGrArGrUrCrCrCrGrGrC rGrGrArGrUrCrGrCrCrA | 24524.68 | 24526 | 3 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 970 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr G*rUrUrCrGrArGrUrCrCrCrGrGr CrGrGrArGrUrCrGrCrCrA | 24524.68 | 24530.7 | |
| 971 | PS 54 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrU*rUrCrGrArGrUrCrCrCrGrGr CrGrGrArGrUrCrGrCrCrA | 24524.68 | 24528.5 | 3 |
| 972 | PS 55 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrU*rCrGrArGrUrCrCrCrGrGr CrGrGrArGrUrCrGrCrCrA | 24524.68 | 24529.7 | 3 |
| 973 | PS 56 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrC*rGrArGrUrCrCrCrGrGr CrGrGrArGrUrCrGrCrCrA | 24524.68 | 24529.4 | 3 |
| 974 | PS 57 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrG*rArGrUrCrCrCrGrGr CrGrGrArGrUrCrGrCrCrA | 24524.68 | 24529.5 | 3 |
| 975 | PS 58 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrA*rGrUrCrCrCrGrGr CrGrGrArGrUrCrGrCrCrA | 24525.3 | 24520.8 | 3 |
| 976 | PS 59 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArG*rUrCrCrCrGrGr CrGrGrArGrUrCrGrCrCrA | 24524.68 | 24529.8 | 2 |
| 977 | PS 60 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrU*rCrCrCrGrGr CrGrGrArGrUrCrGrCrCrA | 24524.68 | 24528.3 | 2 |
| 978 | PS 61 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrC*rCrCrGrGr CrGrGrArGrUrCrGrCrCrA | 24524.68 | 24529.4 | 2 |
| 979 | PS 62 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrC*rCrGrGr CrGrGrArGrUrCrGrCrCrA | 24524.68 | 24530.7 | 2 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 980 | PS 63 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrC*rGrGr CrGrGrArGrUrCrGrCrCrA | 24524.68 | 24528.3 | 1 |
| 981 | PS 64 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrG*rGr CrGrGrArGrUrCrGrCrCrA | 24524.68 | 24524.9 | 1 |
| 982 | PS 65 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrG*r CrGrGrArGrUrCrGrCrCrA | 24524.68 | 24523.8 | 2 |
| 983 | PS 66 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC *rGrGrArGrUrCrGrCrCrA | 24524.68 | 24524.4 | 1 |
| 984 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rG*rGrArGrUrCrGrCrCrA | 24524.68 | 24524.7 | |
| 985 | | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrG*rArGrUrCrGrCrCrA | 24524.68 | 24524.3 | |
| 986 | PS 69 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrA*rGrUrCrGrCrCrA | 24524.68 | 24522.6 | 2 |
| 987 | PS 70 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArG*rUrCrGrCrCrA | 24524.68 | 24524.9 | 2 |
| 988 | PS 71 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrU*rCrGrCrCrA | 24524.68 | 24525.1 | 2 |
| 989 | PS 72 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrC*rGrCrCrA | 24524.68 | 24525.3 | 2 |

TABLE 19-continued

Phosphorothioate-Modified TREMs (TREM-Arg-TGA) and related data

| SEQ ID NO. | Mod | Sequence | Calculated MW | Detected MW | Results |
|---|---|---|---|---|---|
| 990 | PS 73 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrG*rCrCrA | 24525.3 | 24520.4 | 3 |
| 991 | PS 74 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrC*rCrA | 24525.3 | 24533.1 | 3 |
| 992 | PS 75 | rGrGrCrUrCrCrGrUrGrGrCrGrCr ArArUrGrGrArUrArGrCrGrCrAr UrUrGrGrArCrUrUrCrArArArUr UrCrArArArGrGrUrUrCrCrGrGr GrUrUrCrGrArGrUrCrCrCrGrGrC rGrGrArGrUrCrGrCrC*rA | 24525.3 | 24533.2 | 2 |

TABLE 20

2'OMe-Modified TREMs (TREM-Ser-TAG) and related data

| SEQ ID NO. | Mod | Sequence | Calculated MW | Detected MW | Results |
|---|---|---|---|---|---|
| 993 | | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27323.32 | 27329.5 | 2 |
| 994 | OME 1 | mGrArCrGrArGrGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27343.3 | 3 |
| 995 | OME 2 | rGmArCrGrArGrGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27342.9 | 2 |
| 996 | OME 3 | rGrAmCrGrArGrGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27342.3 | 1 |
| 997 | OME 4 | rGrArCmGrArGrGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27339.3 | 3 |
| 998 | OME 5 | rGrArCrGmArGrGrUrGrGrCrCrG rArGrUrGrGrUrUrArArGrGrCrGr ArUrGrGrArCrUrCrUrArArArUr CrCrArUrUrGrUrGrCrUrCrUrGrC | 27337.32 | 27338.7 | 3 |

TABLE 20-continued

| SEQ ID NO. | Mod | Sequence | Calculated MW | Detected MW | Results |
|---|---|---|---|---|---|
| | | rArCrGrCrGrUrGrGrGrUrUrCrGr ArArUrCrCrArUrCrCrUrCrGrU rCrGrCrCrA | | | |
| 999 | OME 6 | rGrArCrGrArAmGrGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27338.8 | 1 |
| 1000 | OME 7 | rGrArCrGrArGmGrUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27341.2 | 1 |
| 1001 | OME 8 | rGrArCrGrArGrGmUrGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27341.4 | 1 |
| 1002 | OME 9 | rGrArCrGrArGrGrUmGrGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27338.5 | 1 |
| 1003 | OME 10 | rGrArCrGrArGrGrUrGmGrCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27338.4 | 2 |
| 1004 | OME 11 | rGrArCrGrArGrGrUrGrGmCrCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27339.3 | 1 |
| 1005 | OME 12 | rGrArCrGrArGrGrUrGrGrCmCrG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27336.2 | 1 |
| 1006 | OME 13 | rGrArCrGrArGrGrUrGrGrCrCmG rArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27344.3 | 1 |
| 1007 | OME 14 | rGrArCrGrArGrGrUrGrGrCrCrG mArGrUrGrGrUrUrArArGrGrCrG rArUrGrGrArCrUrCrUrArArArUr CrCrArUrUrGrUrGrCrUrCrUrGrC rArCrGrCrGrUrGrGrGrUrUrCrGr ArArUrCrCrArUrCrCrUrCrGrU rCrGrCrCrA | 27337.32 | 27332.8 | 1 |

TABLE 20-continued

<u>2'OMe-Modified TREMs (TREM-Ser-TAG) and related data</u>

| SEQ ID NO. | Mod | Sequence | Calculated MW | Detected MW | Results |
|---|---|---|---|---|---|
| 1008 | OME 15 | rGrArCrGrArGrGrUrGrGrCrCrGr AmGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27337.7 | 1 |
| 1009 | OME 16 | rGrArCrGrArGrGrUrGrGrCrCrGr ArGmUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27338.7 | 1 |
| 1010 | OME 17 | rGrArCrGrArGrGrUrGrGrCrCrGr ArGrUmGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27338 | 2 |
| 1011 | OME 18 | rGrArCrGrArGrGrUrGrGrCrCrGr ArGrUrGmGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27339 | 2 |
| 1012 | OME 19 | rGrArCrGrArGrGrUrGrGrCrCrGr ArGrUrGrGmUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27338.1 | 1 |
| 1013 | OME 20 | rGrArCrGrArGrGrUrGrGrCrCrGr ArGrUrGrGrUmUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27338.2 | 1 |
| 1014 | OME 21 | rGrArCrGrArGrGrUrGrGrCrCrGr ArGrUrGrGrUrUmArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27337.3 | 1 |
| 1015 | OME 22 | rGrArCrGrArGrGrUrGrGrCrCrGr ArGrUrGrGrUrUrAmArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27337 | 1 |
| 1016 | OME 23 | rGrArCrGrArGrGrUrGrGrCrCrGr ArGrUrGrGrUrUrArAmGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrArUrCrCrUrCrGrU rCrGrCrCrA | 27337.32 | 27338.3 | 1 |
| 1017 | OME 24 | rGrArCrGrArGrGrUrGrGrCrCrGr ArGrUrGrGrUrUrArArGmGrCrGr | 27337.32 | 27340.9 | 2 |

TABLE 20-continued

| | | 2'OMe-Modified TREMs (TREM-Ser-TAG) and related data | | | |
|---|---|---|---|---|---|
| SEQ ID NO. | Mod | Sequence | Calculated MW | Detected MW | Results |
| | | ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | | | |
| 1018 | OME 25 | rGrArCrGrArGrGrUrGrGrCrCrGr ArGrUrGrGrUrUrArArGrGmCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.8 | 1 |
| 1019 | OME 26 | rGrArCrGrArGrGrUrGrGrCrCrGr ArGrUrGrGrUrUrArArGrGrCmGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27336.8 | 1 |
| 1020 | OME 27 | rGrArCrGrArGrGrUrGrGrCrCrGr ArGrUrGrGrUrUrArArGrGrCrGm ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27339.7 | 2 |
| 1021 | OME 28 | rGrArCrGrArGrGrUrGrGrCrCrGr ArGrUrGrGrUrUrArArGrGrCrGr AmUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.9 | 1 |
| 1022 | OME 29 | rGrArCrGrArGrGrUrGrGrCrCrGr ArGrUrGrGrUrUrArArGrGrCrGr ArUmGrGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.8 | 2 |
| 1023 | OME 30 | rGrArCrGrArGrGrUrGrGrCrCrGr ArGrUrGrGrUrUrArArGrGrCrGr ArUrGmGrArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.5 | 2 |
| 1024 | OME 31 | rGrArCrGrArGrGrUrGrGrCrCrGr ArGrUrGrGrUrUrArArGrGrCrGr ArUrGrGmArCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.7 | 1 |
| 1025 | OME 32 | rGrArCrGrArGrGrUrGrGrCrCrGr ArGrUrGrGrUrUrArArGrGrCrGr ArUrGrGrAmCrUrCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27340.4 | 2 |
| 1026 | OME 33 | rGrArCrGrArGrGrUrGrGrCrCrGr ArGrUrGrGrUrUrArArGrGrCrGr ArUrGrGrArCmUrCrUrArArArUr CrCrArUrUrGrUrGrCrUrCrUrGrC rArCrGrCrGrUrGrGrGrUrUrCrGr | 27337.32 | 27336.2 | 1 |

TABLE 20-continued

| | | 2'OMe-Modified TREMs (TREM-Ser-TAG) and related data | | | |
|---|---|---|---|---|---|
| SEQ ID NO. | Mod | Sequence | Calculated MW | Detected MW | Results |
| | | ArArUrCrCrCrArUrCrCrUrCrGrU rCrGrCrCrA | | | |
| 1027 | OME 34 | rGrArCrGrArGrGrUrGrGrCrCrGr ArGrUrGrGrUrUrArArGrGrCrGr ArUrGrGrArCrUmCrUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27338.4 | 3 |
| 1028 | OME 35 | rGrArCrGrArGrGrUrGrGrCrCrGr ArGrUrGrGrUrUrArArGrGrCrGr ArUrGrGrArCrUrCmUrArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27338.8 | 1 |
| 1029 | OME 36 | rGrArCrGrArGrGrUrGrGrCrCrGr ArGrUrGrGrUrUrArArGrGrCrGr ArUrGrGrArCrUrCrUmArArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27338.1 | 1 |
| 1030 | OME 37 | rGrArCrGrArGrGrUrGrGrCrCrGr ArGrUrGrGrUrUrArArGrGrCrGr ArUrGrGrArCrUrCrUrAmArArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27338 | 1 |
| 1031 | OME 38 | rGrArCrGrArGrGrUrGrGrCrCrGr ArGrUrGrGrUrUrArArGrGrCrGr ArUrGrGrArCrUrCrUrArAmArUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27340.8 | 3 |
| 1032 | OME 39 | rGrArCrGrArGrGrUrGrGrCrCrGr ArGrUrGrGrUrUrArArGrGrCrGr ArUrGrGrArCrUrCrUrArArAmUr CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27337.7 | 3 |
| 1033 | OME 40 | rGrArCrGrArGrGrUrGrGrCrCrGr ArGrUrGrGrUrUrArArGrGrCrGr ArUrGrGrArCrUrCrUrArArArUm CrCrArUrUrGrUrGrCrUrCrUrGrC rArCrGrCrGrUrGrGrGrUrUrCrGr ArArUrCrCrCrArUrCrCrUrCrGrU rCrGrCrCrA | 27337.32 | 27336.6 | 2 |
| 1034 | OME 41 | rGrArCrGrArGrGrUrGrGrCrCrGr ArGrUrGrGrUrUrArArGrGrCrGr ArUrGrGrArCrUrCrUrArArArUr CmCrArUrUrGrUrGrCrUrCrUrGr CrArCrGrCrGrUrGrGrGrUrUrCrG rArArUrCrCrCrArUrCrCrUrCrGr UrCrGrCrCrA | 27337.32 | 27337 | 2 |
| 1035 | | rGrArCrGrArGrGrUrGrGrCrCrGr ArGrUrGrGrUrUrArArGrGrCrGr ArUrGrGrArCrUrCrUrArArArUr CrCmArUrUrGrUrGrCrUrCrUrGr CrArCrGrCrGrUrGrGrGrUrUrCrG rArArUrCrCrCrArUrCrCrUrCrGr UrCrGrCrCrA | 27337.32 | 27337.7 | |

TABLE 20-continued

| | | 2'OMe-Modified TREMs (TREM-Ser-TAG) and related data | | | |
|---|---|---|---|---|---|
| SEQ ID NO. | Mod | Sequence | Calculated MW | Detected MW | Results |
| 1036 | OME 43 | rGrArCrGrArGrGrUrGrGrCrCrGr ArGrUrGrGrUrUrArArGrGrCrGr ArUrGrGrArCrUrCrUrArArArUr CrCrAmUrUrGrUrGrCrUrCrUrGr CrArCrGrCrGrUrGrGrGrUrUrCrG rArArUrCrCrCrArUrCrCrUrCrGr UrCrGrCrCrA | 27337.32 | 27338.3 | 2 |
| 1037 | OME 44 | rGrArCrGrArGrGrUrGrGrCrCrGr ArGrUrGrGrUrUrArArGrGrCrGr ArUrGrGrArCrUrCrUrArArArUr CrCrArUmUrUrGrUrGrCrUrCrUrGr CrArCrGrCrGrUrGrGrGrUrUrCrG rArArUrCrCrCrArUrCrCrUrCrGr UrCrGrCrCrA | 27337.32 | 27338.3 | 1 |
| 1038 | OME 45 | rGrArCrGrArGrGrUrGrGrCrCrGr ArGrUrGrGrUrUrArArGrGrCrGr ArUrGrGrArCrUrCrUrArArArUr CrCrArUrUmGrUrGrCrUrCrUrGr CrArCrGrCrGrUrGrGrGrUrUrCrG rArArUrCrCrCrArUrCrCrUrCrGr UrCrGrCrCrA | 27337.32 | 27338.1 | 1 |
| 1039 | OME 46 | rGrArCrGrArGrGrUrGrGrCrCrGr ArGrUrGrGrUrUrArArGrGrCrGr ArUrGrGrArCrUrCrUrArArArUr CrCrArUrUrGmUrGrCrUrCrUrGr CrArCrGrCrGrUrGrGrGrUrUrCrG rArArUrCrCrCrArUrCrCrUrCrGr UrCrGrCrCrA | 27337.32 | 27336.3 | 2 |
| 1040 | OME 47 | rGrArCrGrArGrGrUrGrGrCrCrGr ArGrUrGrGrUrUrArArGrGrCrGr ArUrGrGrArCrUrCrUrArArArUr CrCrArUrUrGrUmGrCrUrCrUrGr CrArCrGrCrGrUrGrGrGrUrUrCrG rArArUrCrCrCrArUrCrCrUrCrGr UrCrGrCrCrA | 27337.32 | 27336.2 | 2 |
| 1041 | OME 48 | rGrArCrGrArGrGrUrGrGrCrCrGr ArGrUrGrGrUrUrArArGrGrCrGr ArUrGrGrArCrUrCrUrArArArUr CrCrArUrUrGrUrGmCrUrCrUrGr CrArCrGrCrGrUrGrGrGrUrUrCrG rArArUrCrCrCrArUrCrCrUrCrGr UrCrGrCrCrA | 27337.32 | 27338 | 1 |
| 1042 | OME 49 | rGrArCrGrArGrGrUrGrGrCrCrGr ArGrUrGrGrUrUrArArGrGrCrGr ArUrGrGrArCrUrCrUrArArArUr CrCrArUrUrGrUrGrCmUrCrUrGr CrArCrGrCrGrUrGrGrGrUrUrCrG rArArUrCrCrCrArUrCrCrUrCrGr UrCrGrCrCrA | 27337.32 | 27337.6 | 1 |
| 1043 | OME 50 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUmCrUrGr CrArCrGrCrGrUrGrGrGrUrUrCrG rArArUrCrCrCrArUrCrCrUrCrGr UrCrGrCrCrA | 27337.32 | 27337.8 | 1 |
| 1044 | OME 51 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCmUrGr CrArCrGrCrGrUrGrGrGrUrUrCrG rArArUrCrCrCrArUrCrCrUrCrGr UrCrGrCrCrA | 27337.32 | 27338.4 | 1 |
| 1045 | OME 52 | rGrArCrGrArGrGrUrGrGrCrCrGr ArGrUrGrGrUrUrArArGrGrCrGr ArUrGrGrArCrUrCrUrArArArUr | 27337.32 | 27336.7 | 1 |

TABLE 20-continued

2'OMe-Modified TREMs (TREM-Ser-TAG) and related data

| SEQ ID NO. | Mod | Sequence | Calculated MW | Detected MW | Results |
|---|---|---|---|---|---|
| | | CrCrArUrUrGrUrGrGrCrUrCrUmGr CrArCrGrCrGrUrGrGrGrUrUrCrG rArArUrCrCrCrArUrCrCrUrCrGr UrCrGrCrCrA | | | |
| 1046 | OME 53 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGm CrArCrGrCrGrUrGrGrGrUrUrCrG rArArUrCrCrCrArUrCrCrUrCrGr UrCrGrCrCrA | 27337.32 | 27341.4 | 1 |
| 1047 | OME 54 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC mArCrGrCrGrUrGrGrGrUrUrCrG rArArUrCrCrCrArUrCrCrUrCrGr UrCrGrCrCrA | 27337.32 | 27341.3 | 1 |
| 1048 | OME 55 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rAmCrGrCrGrUrGrGrGrUrUrCrG rArArUrCrCrCrArUrCrCrUrCrGr UrCrGrCrCrA | 27337.32 | 27338.6 | 1 |
| 1049 | OME 56 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCmGrCrGrUrGrGrGrUrUrCrG rArArUrCrCrCrArUrCrCrUrCrGr UrCrGrCrCrA | 27337.32 | 27337.7 | 1 |
| 1050 | OME 57 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGmCrGrUrGrGrGrUrUrCrG rArArUrCrCrCrArUrCrCrUrCrGr UrCrGrCrCrA | 27337.32 | 27336.1 | 1 |
| 1051 | OME 58 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCmGrUrGrGrGrUrUrCrG rArArUrCrCrCrArUrCrCrUrCrGr UrCrGrCrCrA | 27337.32 | 27338.6 | 1 |
| 1052 | OME 59 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGmUrGrGrGrUrUrCrG rArArUrCrCrCrArUrCrCrUrCrGr UrCrGrCrCrA | 27337.32 | 27338.6 | 2 |
| 1053 | OME 60 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUmGrGrGrUrUrCrG rArArUrCrCrCrArUrCrCrUrCrGr UrCrGrCrCrA | 27337.32 | 27337.7 | 1 |

TABLE 20-continued

2'OMe-Modified TREMs (TREM-Ser-TAG) and related data

| SEQ ID NO. | Mod | Sequence | Calculated MW | Detected MW | Results |
|---|---|---|---|---|---|
| 1054 | OME 61 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGmGrGrUrUrCrG rArArUrCrCrCrArUrCrCrUrCrGr UrCrGrCrCrA | 27337.32 | 27336.4 | 3 |
| 1055 | OME 62 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGmGrUrUrCrG rArArUrCrCrCrArUrCrCrUrCrGr UrCrGrCrCrA | 27337.32 | 27338.2 | 1 |
| 1056 | OME 63 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGmUrUrCrG rArArUrCrCrCrArUrCrCrUrCrGr UrCrGrCrCrA | 27337.32 | 27336.3 | 1 |
| 1057 | OME 64 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUmUrCrG rArArUrCrCrCrArUrCrCrUrCrGr UrCrGrCrCrA | 27337.32 | 27336.9 | 1 |
| 1058 | OME 65 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUmCrG rArArUrCrCrCrArUrCrCrUrCrGr UrCrGrCrCrA | 27337.32 | 27338.2 | 1 |
| 1059 | OME 66 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCmG rArArUrCrCrCrArUrCrCrUrCrGr UrCrGrCrCrA | 27337.32 | 27336 | 1 |
| 1060 | OME 67 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrG mArArUrCrCrCrArUrCrCrUrCrGr UrCrGrCrCrA | 27337.32 | 27337.5 | 1 |
| 1061 | OME 68 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr AmArUrCrCrCrArUrCrCrUrCrGr UrCrGrCrCrA | 27337.32 | 27336.9 | 1 |
| 1062 | OME 69 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArAmUrCrCrCrArUrCrCrUrCrGr UrCrGrCrCrA | 27337.32 | 27341.1 | 1 |
| 1063 | OME 70 | rGrArCrGrArGrGrUrGrGrCrCrGr ArGrUrGrGrUrUrArArGrGrCrGr ArUrGrGrArCrUrCrUrArArArUr | 27337.32 | 27337.9 | 1 |

TABLE 20-continued

| | | 2'OMe-Modified TREMs (TREM-Ser-TAG) and related data | | | |
|---|---|---|---|---|---|
| SEQ ID NO. | Mod | Sequence | Calculated MW | Detected MW | Results |
| | | CrCrArUrUrGrUrGrCrUrCrUrGrC rArCrGrCrGrUrGrGrGrUrUrCrGr ArArUmCrCrArUrCrCrUrCrGr UrCrGrCrCrA | | | |
| 1064 | OME 71 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCmCrCrArUrCrCrUrCrGr UrCrGrCrCrA | 27337.32 | 27338.1 | 1 |
| 1065 | OME 72 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCmCrArUrCrCrUrCrGr UrCrGrCrCrA | 27337.32 | 27338.7 | 1 |
| 1066 | OME 73 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCmArUrCrCrUrCrGr UrCrGrCrCrA | 27337.32 | 27336.4 | 2 |
| 1067 | OME 74 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrAmUrCrCrUrCrGr UrCrGrCrCrA | 27337.32 | 27337.8 | 1 |
| 1068 | OME 75 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUmCrCrUrCrGr UrCrGrCrCrA | 27337.32 | 27338 | 1 |
| 1069 | OME 76 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCmCrUrCrGr UrCrGrCrCrA | 27337.32 | 27337.6 | 1 |
| 1070 | OME 77 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCmUrCrGr UrCrGrCrCrA | 27337.32 | 27335.9 | 1 |
| 1071 | OME 78 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrUrUrCrGr ArArUrCrCrCrArUrCrCrUmCrGr UrCrGrCrCrA | 27337.32 | 27337.9 | 1 |

TABLE 20-continued

2'OMe-Modified TREMs (TREM-Ser-TAG) and related data

| SEQ ID NO. | Mod | Sequence | Calculated MW | Detected MW | Results |
|---|---|---|---|---|---|
| 1072 | OME 79 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCmGr UrCrGrCrCrA | 27337.32 | 27336.1 | 3 |
| 1073 | OME 80 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGm UrCrGrCrCrA | 27337.32 | 27337.1 | 3 |
| 1074 | OME 81 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGrU mCrGrCrCrA | 27337.32 | 27336.5 | 2 |
| 1075 | OME 82 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGrU rCmGrCrCrA | 27337.32 | 27336 | 3 |
| 1076 | OME 83 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGrU rCrGmCrCrA | 27337.32 | 27337.4 | 1 |
| 1077 | OME 84 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGrU rCrGrCmCrA | 27337.32 | 27338.7 | 1 |
| 1078 | OME 85 | rGrArCrGrArGrGrUrGrGrCrCrGr ArGrUrGrGrUrUrArArGrGrCrGr ArUrGrGrArCrUrCrUrArArArUr CrCrArUrUrGrUrGrCrUrCrUrGrC rArCrGrCrGrUrGrGrGrGrUrUrCrGr ArArUrCrCrCrArUrCrCrUrCrGrU rCrGrCrCmA | 27337.32 | 27337.9 | 1 |

TABLE 21

2'OMe-Modified TREMs (TREM-Gln-TAA) and related data

| SEQ ID NO. | Mod | Sequence | Calculated MW | Detected MW | Results |
|---|---|---|---|---|---|
| 1079 | | rGrGrUrUrCrCrArUrGrGrUrGrGrUr ArArUrGrGrUrArArGrGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24055.37 | 24059.2 | 2 |
| 1080 | OME 1 | mGrGrUrUrCrCrArUrGrGrUrGrGrU rArArUrGrGrUrArArGrGrCrArCrUr | 24069.37 | 24071.7 | 3 |

TABLE 21-continued

| SEQ ID NO. | Mod | Sequence | Calculated MW | Detected MW | Results |
|---|---|---|---|---|---|
| | | CrUrGrGrArCrUrUrUrArArArUr CrCrArGrCrGrArUrCrCrGrArGrU rUrCrGrArGrUrCrUrCrGrGrUrGr GrArArCrCrUrCrCrA | | | |
| 1081 | OME 2 | rGmGrUrUrCrCrArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.8 | 2 |
| 1082 | OME 3 | rGrGmUrUrCrCrArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24069.7 | 1 |
| 1083 | OME 4 | rGrGrUmUrCrCrArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073 | 3 |
| 1084 | OME 5 | rGrGrUrUmCrCrArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24071.3 | 2 |
| 1085 | OME 6 | rGrGrUrUrCmCrArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24074.2 | 1 |
| 1086 | OME 7 | rGrGrUrUrCrCmArUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24074 | 1 |
| 1087 | OME 8 | rGrGrUrUrCrCrAmUrGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24069 | 1 |
| 1088 | OME 9 | rGrGrUrUrCrCrArUmGrGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24070.3 | 1 |
| 1089 | OME 10 | rGrGrUrUrCrCrArUrGmGrUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24069.2 | 2 |
| 1090 | OME 11 | rGrGrUrUrCrCrArUrGrGmUrGrU rArArUrGrGrUrArArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24069.4 | 1 |

TABLE 21-continued

| | | 2'OMe-Modified TREMs (TREM-Gln-TAA) and related data | | | |
|---|---|---|---|---|---|
| SEQ ID NO. | Mod | Sequence | Calculated MW | Detected MW | Results |
| 1091 | OME 12 | rGrGrUrUrCrCrArUrGrGrUmGrU rArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24068.5 | 3 |
| 1092 | OME 13 | rGrGrUrUrCrCrArUrGrGrUrGmU rArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24068.4 | 3 |
| 1093 | OME 14 | rGrGrUrUrCrCrArUrGrGrUrGrU mArArUrGrGrUrArArGrCrArCrU rCrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24070.9 | 2 |
| 1094 | OME 15 | rGrGrUrUrCrCrArUrGrGrUrGrUr AmArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24068.3 | 2 |
| 1095 | OME 16 | rGrGrUrUrCrCrArUrGrGrUrGrUr ArAmUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24067.5 | 2 |
| 1096 | OME 17 | rGrGrUrUrCrCrArUrGrGrUrGrUr ArArUmGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24067.6 | 3 |
| 1097 | OME 18 | rGrGrUrUrCrCrArUrGrGrUrGrUr ArArUrGmGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24067.4 | 3 |
| 1098 | OME 19 | rGrGrUrUrCrCrArUrGrGrUrGrUr ArArUrGrGmUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24067.3 | 1 |
| 1099 | OME 20 | rGrGrUrUrCrCrArUrGrGrUrGrUr ArArUrGrGrUmArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24074 | 1 |
| 1100 | OME 21 | rGrGrUrUrCrCrArUrGrGrUrGrUr ArArUrGrGrUrAmArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24074.8 | 1 |

TABLE 21-continued

| | | 2'OMe-Modified TREMs (TREM-Gln-TAA) and related data | | | |
|---|---|---|---|---|---|
| SEQ ID NO. | Mod | Sequence | Calculated MW | Detected MW | Results |
| 1101 | | rGrGrUrUrCrCrArUrGrGrUrGrUr ArArUrGrGrUrArAmGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.9 | |
| 1102 | OME 23 | rGrGrUrUrCrCrArUrGrGrUrGrUr ArArUrGrGrUrArArGmCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.8 | 3 |
| 1103 | OME 24 | rGrGrUrUrCrCrArUrGrGrUrGrUr ArArUrGrGrUrArArGrCmArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24075.6 | 1 |
| 1104 | OME 25 | rGrGrUrUrCrCrArUrGrGrUrGrUr ArArUrGrGrUrArArGrCrAmCrUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.4 | 1 |
| 1105 | OME 26 | rGrGrUrUrCrCrArUrGrGrUrGrUr ArArUrGrGrUrArArGrCrArCmUr CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.8 | 1 |
| 1106 | OME 27 | rGrGrUrUrCrCrArUrGrGrUrGrUr ArArUrGrGrUrArArGrCrArCrUm CrUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.8 | 2 |
| 1107 | OME 28 | rGrGrUrUrCrCrArUrGrGrUrGrUr ArArUrGrGrUrArArGrCrArCrUr CmUrGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.8 | 3 |
| 1108 | OME 29 | rGrGrUrUrCrCrArUrGrGrUrGrUr ArArUrGrGrUrArArGrCrArCrUr CrUmGrGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.7 | 3 |
| 1109 | OME 30 | rGrGrUrUrCrCrArUrGrGrUrGrUr ArArUrGrGrUrArArGrCrArCrUr CrUrGmGrArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.5 | 3 |
| 1110 | OME 31 | rGrGrUrUrCrCrArUrGrGrUrGrUr ArArUrGrGrUrArArGrCrArCrUr CrUrGrGmArCrUrUrUrArArArUr CrCrArGrCrGrArUrCrCrGrArGrU rUrCrGrArGrUrCrUrCrGrGrUrGr GrArArCrCrUrCrCrA | 24069.37 | 24073.2 | 1 |

TABLE 21-continued

| | | 2'OMe-Modified TREMs (TREM-Gln-TAA) and related data | | | |
|---|---|---|---|---|---|
| SEQ ID NO. | Mod | Sequence | Calculated MW | Detected MW | Results |
| 1111 | OME 32 | rGrGrUrUrCrCrArUrGrGrUrGrUr ArArUrGrGrUrArArGrCrArCrUr CrUrGrGrAmCrUrUrUrArArArUr CrCrArGrCrGrArUrCrCrGrArGrU rUrCrGrArGrUrCrUrCrGrGrUrGr GrArArCrCrUrCrCrA | 24069.37 | 24074.1 | 1 |
| 1112 | OME 33 | rGrGrUrUrCrCrArUrGrGrUrGrUr ArArUrGrGrUrArArGrCrArCrUr CrUrGrGrArCmUrUrUrArArArUr CrCrArGrCrGrArUrCrCrGrArGrU rUrCrGrArGrUrCrUrCrGrGrUrGr GrArArCrCrUrCrCrA | 24069.37 | 24073.7 | 1 |
| 1113 | OME 34 | rGrGrUrUrCrCrArUrGrGrUrGrUr ArArUrGrGrUrArArGrCrArCrUr CrUrGrGrArCrUmUrUrArArArUr CrCrArGrCrGrArUrCrCrGrArGrU rUrCrGrArGrUrCrUrCrGrGrUrGr GrArArCrCrUrCrCrA | 24069.37 | 24074.4 | 2 |
| 1114 | OME 35 | rGrGrUrUrCrCrArUrGrGrUrGrUr ArArUrGrGrUrArArGrCrArCrUr CrUrGrGrArCrUrUmUrArArArUr CrCrArGrCrGrArUrCrCrGrArGrU rUrCrGrArGrUrCrUrCrGrGrUrGr GrArArCrCrUrCrCrA | 24069.37 | 24073.7 | 1 |
| 1115 | OME 36 | rGrGrUrUrCrCrArUrGrGrUrGrUr ArArUrGrGrUrArArGrCrArCrUr CrUrGrGrArCrUrUrUmArArArUr CrCrArGrCrGrArUrCrCrGrArGrU rUrCrGrArGrUrCrUrCrGrGrUrGr GrArArCrCrUrCrCrA | 24069.37 | 24073.3 | 1 |
| 1116 | OME 37 | rGrGrUrUrCrCrArUrGrGrUrGrUr ArArUrGrGrUrArArGrCrArCrUr CrUrGrGrArCrUrUrUrAmArArUr CrCrArGrCrGrArUrCrCrGrArGrU rUrCrGrArGrUrCrUrCrGrGrUrGr GrArArCrCrUrCrCrA | 24069.37 | 24073.3 | 1 |
| 1117 | OME 38 | rGrGrUrUrCrCrArUrGrGrUrGrUr ArArUrGrGrUrArArGrCrArCrUr CrUrGrGrArCrUrUrUrArAmArUr CrCrArGrCrGrArUrCrCrGrArGrU rUrCrGrArGrUrCrUrCrGrGrUrGr GrArArCrCrUrCrCrA | 24069.37 | 24073.8 | 3 |
| 1118 | OME 39 | rGrGrUrUrCrCrArUrGrGrUrGrUr ArArUrGrGrUrArArGrCrArCrUr CrUrGrGrArCrUrUrUrArArAmUr CrCrArGrCrGrArUrCrCrGrArGrU rUrCrGrArGrUrCrUrCrGrGrUrGr GrArArCrCrUrCrCrA | 24069.37 | 24073.6 | 3 |
| 1119 | OME 40 | rGrGrUrUrCrCrArUrGrGrUrGrUr ArArUrGrGrUrArArGrCrArCrUr CrUrGrGrArCrUrUrUrArArArUm CrCrArGrCrGrArUrCrCrGrArGrU rUrCrGrArGrUrCrUrCrGrGrUrGr GrArArCrCrUrCrCrA | 24069.37 | 24073.3 | 2 |
| 1120 | OME 41 | rGrGrUrUrCrCrArUrGrGrUrGrUr ArArUrGrGrUrArArGrCrArCrUr CrUrGrGrArCrUrUrUrArArArUr CmCrArGrCrGrArUrCrCrGrArGr UrUrCrGrArGrUrCrUrCrGrGrUr GrGrArArCrCrUrCrCrA | 24069.37 | 24074 | 3 |

TABLE 21-continued

2'OMe-Modified TREMs (TREM-Gln-TAA) and related data

| SEQ ID NO. | Mod | Sequence | Calculated MW | Detected MW | Results |
|---|---|---|---|---|---|
| 1121 | OME 42 | rGrGrUrUrCrCrArUrGrGrUrGrUr ArArUrGrGrUrArArGrCrArCrUr CrUrGrGrArCrUrUrUrArArArUr CrCmArGrCrGrArUrCrCrGrArGr UrUrCrGrArGrUrCrUrCrGrGrUr GrGrArArCrCrUrCrCrA | 24069.37 | 24073.6 | 2 |
| 1122 | OME 43 | rGrGrUrUrCrCrArUrGrGrUrGrUr ArArUrGrGrUrArArGrCrArCrUr CrUrGrGrArCrUrUrUrArArArUr CrCrAmGrCrGrArUrCrCrGrArGr UrUrCrGrArGrUrCrUrCrGrGrUr GrGrArArCrCrUrCrCrA | 24069.37 | 24074.3 | 1 |
| 1123 | OME 44 | rGrGrUrUrCrCrArUrGrGrUrGrUr ArArUrGrGrUrArArGrCrArCrUr CrUrGrGrArCrUrUrUrArArArUr CrCrArGmCrGrArUrCrCrGrArGr UrUrCrGrArGrUrCrUrCrGrGrUr GrGrArArCrCrUrCrCrA | 24069.37 | 24074.6 | 3 |
| 1124 | OME 45 | rGrGrUrUrCrCrArUrGrGrUrGrUr ArArUrGrGrUrArArGrCrArCrUr CrUrGrGrArCrUrUrUrArArArUr CrCrArGrCmGrArUrCrCrGrArGr UrUrCrGrArGrUrCrUrCrGrGrUr GrGrArArCrCrUrCrCrA | 24069.37 | 24074.5 | 1 |
| 1125 | OME 46 | rGrGrUrUrCrCrArUrGrGrUrGrUr ArArUrGrGrUrArArGrCrArCrUr CrUrGrGrArCrUrUrUrArArArUr CrCrArGrCrGmArUrCrCrGrArGr UrUrCrGrArGrUrCrUrCrGrGrUr GrGrArArCrCrUrCrCrA | 24069.37 | 24073.5 | 1 |
| 1126 | OME 47 | rGrGrUrUrCrCrArUrGrGrUrGrUr ArArUrGrGrUrArArGrCrArCrUr CrUrGrGrArCrUrUrUrArArArUr CrCrArGrCrGrAmUrCrCrGrArGr UrUrCrGrArGrUrCrUrCrGrGrUr GrGrArArCrCrUrCrCrA | 24069.37 | 24073.8 | 1 |
| 1127 | OME 48 | rGrGrUrUrCrCrArUrGrGrUrGrUr ArArUrGrGrUrArArGrCrArCrUr CrUrGrGrArCrUrUrUrArArArUr CrCrArGrCrGrArUmCrCrGrArGr UrUrCrGrArGrUrCrUrCrGrGrUr GrGrArArCrCrUrCrCrA | 24069.37 | 24074.2 | 3 |
| 1128 | OME 49 | rGrGrUrUrCrCrArUrGrGrUrGrUr ArArUrGrGrUrArArGrCrArCrUr CrUrGrGrArCrUrUrUrArArArUr CrCrArGrCrGrArUrCmGrArGr UrUrCrGrArGrUrCrUrCrGrGrUr GrGrArArCrCrUrCrCrA | 24069.37 | 24074.5 | 3 |
| 1129 | OME 50 | rGrGrUrUrCrCrArUrGrGrUrGrUr ArArUrGrGrUrArArGrCrArCrUr CrUrGrGrArCrUrUrUrArArArUr CrCrArGrCrGrArUrCrCmGrArGr UrUrCrGrArGrUrCrUrCrGrGrUr GrGrArArCrCrUrCrCrA | 24069.37 | 24073.5 | 2 |
| 1130 | OME 51 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGmArGr UrUrCrGrArGrUrCrUrCrGrGrUr GrGrArArCrCrUrCrCrA | 24069.37 | 24074.5 | 3 |

TABLE 21-continued

| | | 2'OMe-Modified TREMs (TREM-Gln-TAA) and related data | | | |
|---|---|---|---|---|---|
| SEQ ID NO. | Mod | Sequence | Calculated MW | Detected MW | Results |
| 1131 | OME 52 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrAmGr UrUrCrGrArGrUrCrUrCrGrGrUr GrGrArArCrCrUrCrCrA | 24069.37 | 24072.4 | 3 |
| 1132 | OME 53 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGm UrUrCrGrArGrUrCrUrCrGrGrUr GrGrArArCrCrUrCrCrA | 24069.37 | 24069.5 | 3 |
| 1133 | OME 54 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU mUrCrGrArGrUrCrUrCrGrGrUrG rGrArArCrCrUrCrCrA | 24069.37 | 24068.7 | 1 |
| 1134 | OME 55 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUmCrGrArGrUrCrUrCrGrGrUrG rGrArArCrCrUrCrCrA | 24069.37 | 24068.3 | 2 |
| 1135 | OME 56 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCmGrArGrUrCrUrCrGrGrUrG rGrArArCrCrUrCrCrA | 24069.37 | 24069.5 | 2 |
| 1136 | OME 57 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGmArGrUrCrUrCrGrGrUrG rGrArArCrCrUrCrCrA | 24069.37 | 24068.2 | 1 |
| 1137 | OME 58 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrAmGrUrCrUrCrGrGrUrG rGrArArCrCrUrCrCrA | 24069.37 | 24067.8 | 3 |
| 1138 | OME 59 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGmUrCrUrCrGrGrUrG rGrArArCrCrUrCrCrA | 24069.37 | 24068.2 | 1 |
| 1139 | OME 60 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUmCrUrCrGrGrUrG rGrArArCrCrUrCrCrA | 24069.37 | 24068 | 3 |
| 1140 | OME 61 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCmUrCrGrGrUrG rGrArArCrCrUrCrCrA | 24069.37 | 24068.1 | 3 |

TABLE 21-continued

| | | 2'OMe-Modified TREMs (TREM-Gln-TAA) and related data | | | |
|---|---|---|---|---|---|
| SEQ ID NO. | Mod | Sequence | Calculated MW | Detected MW | Results |
| 1141 | OME 62 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUmCrGrGrUrG rGrArArCrCrUrCrCrA | 24069.37 | 24068.1 | 1 |
| 1142 | OME 63 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCmGrGrUrG rGrArArCrCrUrCrCrA | 24069.37 | 24067.6 | 3 |
| 1143 | OME 64 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGmGrUrG rGrArArCrCrUrCrCrA | 24069.37 | 24069.3 | 3 |
| 1144 | OME 65 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGmUrG rGrArArCrCrUrCrCrA | 24069.37 | 24067.3 | 3 |
| 1145 | OME 66 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUmG rGrArArCrCrUrCrCrA | 24069.37 | 24068.7 | 3 |
| 1146 | OME 67 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrG mGrArArCrCrUrCrCrA | 24069.37 | 24067 | 2 |
| 1147 | OME 68 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GmArArCrCrUrCrCrA | 24069.37 | 24068.3 | 3 |
| 1148 | OME 69 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrAmArCrCrUrCrCrA | 24069.37 | 24067.6 | 3 |
| 1149 | OME 70 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArAmCrCrUrCrCrA | 24069.37 | 24067 | 1 |
| 1150 | OME 71 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCmCrUrCrCrA | 24069.37 | 24067.2 | 3 |

TABLE 21-continued

2'OMe-Modified TREMs (TREM-Gln-TAA) and related data

| SEQ ID NO. | Mod | Sequence | Calculated MW | Detected MW | Results |
|---|---|---|---|---|---|
| 1151 | OME 72 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCmUrCrCrA | 24069.37 | 24066.9 | 3 |
| 1152 | OME 73 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUmCrCrA | 24069.37 | 24067 | 3 |
| 1153 | OME 74 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCmCrA | 24069.37 | 24067.6 | 3 |
| 1154 | OME 75 | rGrGrUrUrCrCrArUrGrGrUrGrUr ArArUrGrGrUrArArGrCrArCrUr CrUrGrGrArCrUrUrUrArArArUr CrCrArGrCrGrArUrCrCrGrArGrU rUrCrGrArGrUrCrUrCrGrGrUrGr GrArArCrCrUrCrCmA | 24069.37 | 24067.3 | 3 |

TABLE 22

Additional modified TREMs (TREM-Arg-TGA) and related data

| SEQ ID NO. | Mod | Sequence | Calculated MW | Detected MW | Results |
|---|---|---|---|---|---|
| 1155 | CCA | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCr G | 23569.11 | 23574.5 | 3 |
| 1156 | m1, m73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm GrCrCrA | 24536.69 | 24536.1 | 3 |
| 1157 | m1, m52, m73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGmGrGrUrUrCrGr ArGrUrCrCrCrGrGrCrGrGrArGrUrC mGrCrCrA | 24550.69 | 24548.1 | 3 |
| 1158 | m1, m50, m52, m73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCmCrGmGrGrUrUrCrGr ArGrUrCrCrCrGrGrCrGrGrArGrUrC mGrCrCrA | 24564.69 | 24564.3 | 3 |
| 1159 | m1, m18, m50, m52, m73 | mGrGrCrUrCrCrGrUrGrGrCrGrCrAr ArUrGmGrArUrArGrCrGrCrArUrUr GrGrArCrUrUrCrArArArUrUrCrArA rArGrGrUrUrCmCrGmGrGrUrUrCrG rArGrUrCrCrCrGrGrCrGrGrArGrUr CmGrCrCrA | 24578.69 | 24585.7 | 3 |
| 1160 | m8, m52 | rGrGrCrUrCrCrGmUrGrGrCrGrCrAr ArUrGrGrArUrArGrCrGrCrArUrUrG | 24536.69 | 24536.7 | 3 |

TABLE 22-continued

Additional modified TREMs (TREM-Arg-TGA) and related data

| SEQ ID NO. | Mod | Sequence | Calculated MW | Detected MW | Results |
|---|---|---|---|---|---|
| | | rGrArCrUrUrCrArArArUrUrCrArAr ArGrGrUrUrCrCrGmGrGrUrUrCrGr ArGrUrCrCrCrGrGrCrGrGrArGrUrC rGrCrCrA | | | |
| 1161 | m1, m17, m18, m50, m52, m73 | mGrGrCrUrCrCrGrUrGrGrCrGrCrAr ArUmGmGrArUrArGrCrGrCrArUrU rGrGrArCrUrUrCrArArArUrUrCrAr ArArGrGrUrUrCmCrGmGrGrUrUrCr GrArGrUrCrCrCrGrGrCrGrGrArGrU rCmGrCrCrA | 24592.7 | 24591.3 | 3 |
| 1162 | m39, m52 | rGrGrCrUrCrCrGrUrGrGrCrGrCrAr ArUrGrGrArUrArGrCrGrCrArUrUrG rGrArCrUrUrCrArArAmUrUrCrArAr ArGrGrUrUrCrCrGmGrGrUrUrCrGr ArGrUrCrCrCrGrGrCrGrGrArGrUrC rGrCrCrA | 24536.69 | 24539.1 | 2 |
| 1163 | m52, m62 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGmGrGrUrUrCrGr ArGrUrCmCrCrGrGrCrGrGrArGrUr CrGrCrCrA | 24536.68 | 24535.5 | 3 |
| 1164 | moe (1); PS (1) | moeG*rGrCrUrCrCrGrUrGrGrCrGrC rArArUrGrGrArUrArGrCrGrCrArUr UrGrGrArCrUrUrCrArArArUrUrCrA rArArGrGrUrUrCrCrGrGrCrGrGrUrUrCr GrArGrUrCrCrCrGrGrCrGrGrArGrU rCrGrCrCrA | 24582.69 | 24581.7 | 3 |
| 1165 | m (1); PS (1) | mG*rGrCrUrCrCrGrUrGrGrCrGrCrA rArUrGrGrArUrArGrCrGrCrArUrUr GrGrArCrUrUrCrArArArUrUrCrArA rArGrGrUrUrCrCrGrGrCrGrGrUrUrCrGr ArGrUrCrCrCrGrGrCrGrGrArGrUrC rGrCrCrA | 24538.69 | 24545.5 | 3 |
| 1166 | m (1); PS (1, 2, 74, 75) | mG*rG*rCrUrCrCrGrUrGrGrCrGrCr ArArUrGrGrArUrArGrCrGrCrArUrU rGrGrArCrUrUrCrArArArUrUrCrAr ArArGrGrUrUrCrCrGrGrGrUrUrCrG rArGrUrCrCrCrGrGrCrGrGrArGrUr CrGrC*rC*rA | 24586.69 | 24594.9 | 3 |
| 1167 | m (1, 2); PS (1, 2, 74, 75) | mG*mG*rCrUrCrCrGrUrGrGrCrGrC rArArUrGrGrArUrArGrCrGrCrArUr UrGrGrArCrUrUrCrArArArUrUrCrA rArArGrGrUrUrCrCrGrGrCrGrGrUrUrCr GrArGrUrCrCrCrGrGrCrGrGrArGrU rCrGrC*rC*rA | 24600.69 | 24603.5 | 3 |
| 1168 | m (1, 2, 74, 75); PS (1, 2, 74, 75) | mG*mG*rCrUrCrCrGrUrGrGrCrGrC rArArUrGrGrArUrArGrCrGrCrArUr UrGrGrArCrUrUrCrArArArUrUrCrA rArArGrGrUrUrCrCrGrGrCrGrGrUrUrCr GrArGrUrCrCrCrGrGrCrGrGrArGrU rCrGmC*mC*rA | 24628.68 | 24632.7 | 3 |
| 1169 | m (1, 2, 74, 75, 76); PS (1, 2, 74, 75) | mG*mG*rCrUrCrCrGrUrGrGrCrGrC rArArUrGrGrArUrArGrCrGrCrArUr UrGrGrArCrUrUrCrArArArUrUrCrA rArArGrGrUrUrCrCrGrGrCrGrGrUrUrCr GrArGrUrCrCrCrGrGrCrGrGrArGrU rCrGmC*mC*mA | 24642.69 | 24646.2 | 3 |
| 1170 | | mGrGrCrUrCrCrGrUrGrGrCrGrCrAr ArUrGrGrArUrArGrCrGrCrArUrUm GmGrArCrUrUrCrArArArUrUrCrAr ArArGrGrUrUrCmCrGmGrGrUrUm CrGrArGrUrCrCrCrGmGrCrGrGrAr GmUrCmGrCrCrA | 24634.7 | 24632.6 | 3 |

TABLE 22-continued

Additional modified TREMs (TREM-Arg-TGA) and related data

| SEQ ID NO. | Mod | Sequence | Calculated MW | Detected MW | Results |
|---|---|---|---|---|---|
| 1171 | | mGrGrCmUrCrCrGrUrGrGrCrGrCrA rArUrGrGrAmUrArGrCrGrCrArUrU mGmGrArCrUrUrCrArArArUrUrCrA rArArGrGrUrUrCmCrGmGrGrUrUm CrGrArGrUrCrCrCrGmGrCrGrGrAr GmUrCmGrCrCrA | 24662.7 | 24667.1 | 2 |
| 1172 | | mGrGrCmUrCrCrGrUrGrGrCrGmCr ArArUmGmGrAmUrArGrCrGmCrAr UrUmGmGrArCrUrUrCrArArArUrU rCrArArArGrGrUrUmCmCrGmGrGr UrUmCrGrAmGrUrCrCrCrGmGrCrG rGmArGmUmCmGrCrCrA | 24774.7 | 24779.4 | 3 |
| 1173 | | mGrGrCmUrCrCrGrUrGmGmCmGm CrArArUmGmGrAmUrArGrCrGmCr ArUrUmGmGrArCrUrUrCrArArArU rUrCrArArAmGrGrUrUmCmCrGmG rGrUrUmCrGrAmGrUmCrCrCrGmG mCrGmGmArGmUmCmGrCrCrA | 24872.7 | 24881.5 | 1 |
| 1174 | | mGrGrCmUrCmCrGrUrGmGmCmG mCrArArUmGmGrAmUrAmGrCrG mCrArUrUmGmGrArCrUrUrCrArAr ArUrUmCmAmArAmGrGrUrUmCm CrGmGrGrUrUmCrGrAmGrUmCmC rCrGmGmCmGmGmArGmUmCmGr CrCmA | 24984.71 | 24992.1 | 1 |
| 1175 | N-1; m73 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm GrCrC | 24193.48 | 24197.4 | |
| 1176 | N-2; m73 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm GrC | 23888.3 | 23889.2 | 3 |
| 1177 | N-3; m73 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm G | 23583.11 | 23583.8 | 1 |
| 1178 | N-3, m1, 73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm G | 23597.12 | 23598.2 | 1 |
| 1179 | N-2; m1, 73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm GrC | 23902.3 | 23904.4 | 3 |
| 1180 | N-1; m1, 73 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCm GrCrC | 24207.48 | 24208.3 | 3 |
| 1181 | m1-6, DS1, DS2, TS1 | mGmGmCmUmCmCrGrUrGmGmC mGmCrArArUrGrGrArUrAmGmCm GmCrArUrUrGrGrArCrUrUrCrArAr ArUrUrCrArArArGrGrUrUmCmCm | 24774.69 | 24779.6 | 3 |

TABLE 22-continued

Additional modified TREMs (TREM-Arg-TGA) and related data

| SEQ ID NO. | Mod | Sequence | Calculated MW | Detected MW | Results |
|---|---|---|---|---|---|
| | | GmGmGrUrUrCrGrArGrUrCrCrCrGr GrCrGrGrArGrUrCrGrCrCrA | | | |
| 1182 | m1-6, DS1, DS2, TS1, m73 | mGmGmCmUmCmCrGrUrGmGmC mGmCrArArUrGrGrArUrAmGmCm GmCrArUrUrGrGrArCrUrUrCrArAr ArUrUrCrArArArGrGrUrUmCmCm GmGmGrUrUrCrGrArGrUrCrCrCrGr GrCrGrGrArGrUrCmGrCrCrA | 24788.69 | 24782.3 | 3 |
| 1183 | N-3, m1-6, DS1, DS2, TS1, m73 | mGmGmCmUmCmCrGrUrGmGmC mGmCrArArUrGrGrArUrAmGmCm GmCrArUrUrGrGrArCrUrUrCrArAr ArUrUrCrArArArGrGrUrUmCmCm GmGmGrUrUrCrGrArGrUrCrCrCrGr GrCrGrGrArGrUrCmG | 23849.11 | 23854.6 | 1 |
| 1184 | N-3, m1 | mGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrUrCrGrA rGrUrCrCrCrGrGrCrGrGrArGrUrCr G | 23583.11 | 23587.8 | 3 |
| 1185 | N-3, m1-6 | mGmGmCmUmCmCrGrUrGrGrCrGr CrArArUrGrGrArUrArGrCrGrCrArU rUrGrGrArCrUrUrCrArArArUrUrCr ArArArGrGrUrUrCrCrGrGrGrUrUrC rGrArGrUrCrCrCrGrGrCrGrGrArGr UrCrG | 23653.11 | 23646.8 | 3 |
| 1186 | N-3, PS 54 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrU*rUrCrGr ArGrUrCrCrCrGrGrCrGrGrArGrUrC rG | 23585.11 | 23589.6 | 3 |
| 1187 | N-3, PS 55 | rGrGrCrUrCrCrGrUrGrGrCrGrCrAr ArUrGrGrArUrArGrCrGrCrArUrUrG rGrArCrUrUrCrArArArUrUrCrArAr ArGrGrUrUrCrCrGrGrGrUrU*rCrGr ArGrUrCrCrCrGrGrCrGrGrArGrUrC rG | 23585.11 | 23589.9 | |

Example 12: Correction of a Missense Mutation in an ORF with Administration of a TREM This example describes the administration of a TREM to correct a missense mutation. In this example, a TREM translates a reporter with a missense mutation into a wild type (WT) protein by incorporation of the WT amino acid (at the missense position) in the protein.

Host Cell Modification

A cell line stably expressing a GFP reporter construct containing a missense mutation, for example T2031 or E222G, which prevent GFP excitation at the 470 nm and 390 nm wavelengths, is generated using the FlpIn system according to manufacturer's instructions. Briefly, HEK293T (293T ATCC® CRL-3216) cells are co-transfected with an expression vector containing a GFP reporter with a missense mutation, such as pcDNA5/FRT-NanoLuc-TAA and a pOG44 Flp-Recombinase expression vector using Lipofectamine2000 according to manufacturer's instructions. After 24 hours, the media is replaced with fresh media. The next day, the cells are split 1:2 and selected with 100 ug/mL Hygromycin for 5 days. The remaining cells are expanded and tested for reporter construct expression.

Synthesis and Preparation of TREM

The TREM is synthesized as described in Example 1 and quality control methods as described in Examples 7-9 are performed. To ensure proper folding, the TREM is heated at 85° C. for 2 minutes and then snap cooled at 4° C. for 5 minutes.

Transfection of Non-Cognate TREM into Host Cells

To deliver the TREM to mammalian cells, 100 nM of TREM is transfected into cells expressing the ORF having a missense mutation using lipofectamine 2000 reagents according to the manufacturer's instructions. After 6-18 hours, the transfection media is removed and replaced with fresh complete media.

Missense Mutation Correction Assay

To monitor the efficacy of the TREM to correct the missense mutation in the reporter construct, 24-48 hours after TREM transfection, cell media is replaced, and cell fluorescence is measured. As a negative control, no TREM is transfected in the cells and as a positive control, cells expressing WT GFP are used for this assay. If the TREM is functional, it is expected that the GFP protein produced fluoresces when illuminated with a 390 nm excitation wavelength using a fluorimeter, as observed in the positive control. If the TREM is not functional, the GFP protein produced fluoresces only when excited with a 470 nm wavelength, as is observed in the negative control.

Example 13: Evaluation of Protein Expression Levels of SMC-Containing ORF with Administration of a TREM This example describes administration of a TREM to alter expression levels of an SMC-containing ORF.

To create a system in which to study the effects of TREM administration on protein expression levels of an SMC-containing protein, in this example, from the PNPL3A gene coding for adiponutrin, a plasmid containing the PNPL3A rs738408 ORF sequence is transfected in the normal human hepatocyte cell line THLE-3, edited by CRISPR/Cas to contain a frameshift mutation in a coding exon of PNPLA3 to knock out endogenous PNPLA3 (THLE-3_PNPLA3KO cells). As a control, an aliquot of THLE-3_PNPLA3KO cells are transfected with a plasmid containing the wildtype PNPL3A ORF sequence.

Synthesis and Preparation of TREM

An arginine TREM is synthesized as described in Example 1 and quality control methods as described in Examples 7-9 are performed. To ensure proper folding, the TREM is heated at 85° C. for 2 minutes and then snap cooled at 4° C. for 5 minutes.

Evaluation of Protein Level of SMC-Containing ORF

A TREM is delivered to the THLE-3_PNPLA3KO cells containing the rs738408 ORF sequence as well as to the THLE-3_PNPLA3KO cells containing the wildtype PNPL3A ORF sequence. In this example, the TREM contains a proline isoacceptor containing an AGG anticodon, that base pairs to the CCT codon, i.e. with the sequence GGCUCGUUGGUCUAGGGGUAUGAUUCUCGC-UUAGGGUGCGAGAGGUCCCGGGUU CAAAUCCCGGACGAGCCC (SEQ ID NO: 1292). A time course is performed ranging from 30 minutes to 6 hours with hour-long interval time points. At each time point, cells are trypsinized, washed and lysed. Cell lysates are analyzed by Western blotting and blots are probed with antibodies against the adiponutrin protein. A total protein loading control, such as GAPDH, actin or tubulin, is also probed as a loading control.

The methods described in this example can be adopted for use to evaluate the expression levels of the adiponutrin protein in rs738408 ORF containing cells.

Example 14: Modulation of Protein Translation Rate of SMC-Containing ORF with TREM Administration This example describes administration of a TREM to alter the rate of protein translation of an SMC-containing ORF.

To monitor the effects of TREM addition on translation elongation rates, an in vitro translation system, in this example the RRL system from Promega, is used in which the fluorescence change over time of a reporter gene, in this example GFP, is a surrogate for translation rates.

Synthesis and Preparation of TREM

An arginine TREM is synthesized as described in Example 1 and quality control methods as described in Examples 7-9 are performed. To ensure proper folding, the TREM is heated at 85° C. for 2 minutes and then snap cooled at 4° C. for 5 minutes.

Evaluation of Protein Translation Rate of SMC-Containing ORF

First, a rabbit reticulocyte lysate that is depleted of the endogenous tRNA using an antisense oligonucleotide targeting the sequence between the anticodon and variable loop is generated (see, e.g., Cui et al. 2018. Nucleic Acids Res. 46 (12): 6387-6400). In this example, a TREM comprising an alanine isoacceptor containing an UGC anticodon, that base pairs to the GCA codon, i.e. with the sequence GGGGAUGUAGCUCAGUGGUAGAGCGCAUGC-UUUGCAUGUAUGAGGUCCCGGGUU CGAUCCCCGGCAUCUCCA (SEQ ID NO: 1293) is added to the in vitro translation assay lysate in addition to 0.1-0.5 ug/uL of mRNA coding for the wildtype TERT ORF fused to the GFP ORF by a linker or an mRNA coding for the rs2736098 TERT ORF fused to the GFP ORF by a linker. The progress of GFP mRNA translation is monitored by fluorescence increase on a microplate reader at 37° C. using $\lambda_{ex}485/\lambda_{em}528$ with data points collected every 30 seconds over a period of 1 hour. The amount of fluorescence change over time is plotted to determine the rate of translation elongation of the wildtype ORF compared to the rs2736098 ORF with and without TREM addition. The methods described in this example can be adopted for use to evaluate the translation rate of the rs2736098 ORF and the wildtype ORF in the presence or absence of TREM.

---

SEQUENCE LISTING (1293 sequences)

SEQ ID NO: 1 - DNA, 72 bp, Homo sapiens
  source 1..72: mol_type = genomic DNA
gggggtatagctcagtggtagagcgcgtgcttagcatgcacgaggtcctgggttcgatccccagtacctcca

SEQ ID NO: 2 - DNA, 73 bp, Homo sapiens
  source 1..73: mol_type = genomic DNA
ggggaattagctcaagtggtagagcgcttgcttagcacgcaagaggtagtgggatcgatgcccacattctcca

SEQ ID NO: 3 - DNA, 73 bp, Homo sapiens
  source 1..73: mol_type = genomic DNA
ggggaattagctcaaatggtagagcgctcgcttagcatgcgagaggtagcgggatcgatgcccgcattctcca

SEQ ID NO: 4 - DNA, 73 bp, Homo sapiens
  source 1..73: mol_type = genomic DNA
ggggaattagctcaagtggtagagcgcttgcttagcatgcaagaggtagtgggatcgatgcccacattctcca

SEQ ID NO: 5 - DNA, 73 bp, Homo sapiens
  source 1..73: mol_type = genomic DNA
ggggaattagctcaagcggtagagcgcttgcttagcatgcaagaggtagtgggatcgatgcccacattctcca

SEQ ID NO: 6 - DNA, 73 bp, Homo sapiens
  source 1..73: mol_type = genomic DNA
ggggaattagctcaagtggtagagcgcttgcttagcatgcaagaggtagtgggatcaatgcccacattctcca

SEQ ID NO: 7 - DNA, 73 bp, Homo sapiens
  source 1..73: mol_type = genomic DNA
ggggaattagctcaagtggtagagcgctcgcttagcatgcgagaggtagtgggatcgatgcccgcattctcca

SEQ ID NO: 8 - DNA, 73 bp, Homo sapiens
  source 1..73: mol_type = genomic DNA
ggggaattagcccaagtggtagagcgcttgcttagcatgcaagaggtagtgggatcgatgcccacattctcca

SEQ ID NO: 9 - DNA, 72 bp, Homo sapiens
  source 1..72: mol_type = genomic DNA
gggggtgtagctcagtggtagagcgcgtgcttagcatgcacgaggccccgggttcaatccccggcacctcca

SEQ ID NO: 10 - DNA, 72 bp, Homo sapiens
  source 1..72: mol_type = genomic DNA
gggggtgtagctcagtggtagagcgcgtgcttagcatgtacgaggtcccgggttcaatccccggcacctcca

SEQ ID NO: 11 - DNA, 72 bp, Homo sapiens
  source 1..72: mol_type = genomic DNA
ggggatgtagctcagtggtagagcgcatgcttagcatgcatgaggtcccgggttcgatccccagcatctcca

SEQ ID NO: 12 - DNA, 72 bp, Homo sapiens
  source 1..72: mol_type = genomic DNA
gggggtgtagctcagtggtagagcgcgtgcttagcatgcacgaggccctgggttcaatccccagcacctcca

SEQ ID NO: 13 - DNA, 72 bp, Homo sapiens
  source 1..72: mol_type = genomic DNA
gggggtatagctcagcggtagagcgcgtgcttagcatgcacgaggtcctgggttcaatccccaatacctcca

SEQ ID NO: 14 - DNA, 72 bp, Homo sapiens
  source 1..72: mol_type = genomic DNA
gggggtgtagctcagtggtagagcgcgtgcttagcatgcacgaggccccgggttcaatccctggcacctcca

SEQ ID NO: 15 - DNA, 73 bp, Homo sapiens
  source 1..73: mol_type = genomic DNA
gggggattagctcaaatggtagagcgctcgcttagcatgcgagaggtagcgggatcgatgcccgcatcctcca

SEQ ID NO: 16 - DNA, 73 bp, Homo sapiens
  source 1..73: mol_type = genomic DNA
ggggaattagctcaggcggtagagcgctcgcttagcatgcgagaggtagcgggatcgacgcccgcattctcca

SEQ ID NO: 17 - DNA, 72 bp, Homo sapiens
  source 1..72: mol_type = genomic DNA
ggggatgtagctcagtggtagagcgcatgcttcgcatgtatgaggtcccgggttcgatccccggcatctcca

SEQ ID NO: 18 - DNA, 72 bp, Homo sapiens
  source 1..72: mol_type = genomic DNA
ggggatgtagctcagtggtagagcgcatgcttcgcatgtatgaggccccgggttcgatccccggcatctcca

SEQ ID NO: 19 - DNA, 72 bp, Homo sapiens
  source 1..72: mol_type = genomic DNA
ggggatgtagctcagtggtagagcgcgcgcttcgcatgtgtgaggtcccgggttcaatccccggcatctcca

SEQ ID NO: 20 - DNA, 72 bp, Homo sapiens
  source 1..72: mol_type = genomic DNA
gggggtgtagctcagtggtagagcgcgtgcttcgcatgtacgaggccccgggttcgacccccggctcctcca

SEQ ID NO: 21 - DNA, 72 bp, Homo sapiens
  source 1..72: mol_type = genomic DNA
gggggtgtagctcagtggtagagcgcatgctttgcatgtatgaggtcccgggttcgatccccggcacctcca

SEQ ID NO: 22 - DNA, 72 bp, Homo sapiens
  source 1..72: mol_type = genomic DNA
ggggatgtagctcagtggtagagcgcatgctttgcatgtatgaggtcccgggttcgatccccggcatctcca

SEQ ID NO: 23 - DNA, 72 bp, Homo sapiens
  source 1..72: mol_type = genomic DNA
ggggatgtagctcagtggtagagcgcatgctttgcatgtatgaggccccgggttcgatccccggcatctcca

SEQ ID NO: 24 - DNA, 72 bp, Homo sapiens
  source 1..72: mol_type = genomic DNA
ggggatgtagctcagtggtagagcgcatgctttgcacgtatgaggccccgggttcaatccccggcatctcca

SEQ ID NO: 25 - DNA, 72 bp, Homo sapiens
  source 1..72: mol_type = genomic DNA
gggggtgtagctcagtggtagagcgcatgctttgcatgtatgaggcctcgggttcgatccccgacacctcca

SEQ ID NO: 26 - DNA, 72 bp, Homo sapiens
  source 1..72: mol_type = genomic DNA
gggggtgtagctcagtggtagagcacatgctttgcatgtgtgaggccccgggttcgatccccggcacctcca

SEQ ID NO: 27 - DNA, 71 bp, Homo sapiens
  source 1..71: mol_type = genomic DNA
gggggtgtagctcagtggtagagcgcatgctttgcatgtatgaggcctcggttcgatccccgacacctcca

SEQ ID NO: 28 - DNA, 73 bp, Homo sapiens
  source 1..73: mol_type = genomic DNA
gggccagtggcgcaatggataacgcgtctgactacggatcagaagattccaggttcgactcctggctggctcg

SEQ ID NO: 29 - DNA, 73 bp, Homo sapiens
  source 1..73: mol_type = genomic DNA
gggccagtggcgcaatggataacgcgtctgactacggatcagaagattctaggttcgactcctggctggctcg

SEQ ID NO: 30 - DNA, 73 bp, Homo sapiens
  source 1..73: mol_type = genomic DNA
ggccgcgtggcctaatggataaggcgtctgattccggatcagaagattgagggttcgagtcccttcgtggtcg

SEQ ID NO: 31 - DNA, 73 bp, Homo sapiens
  source 1..73: mol_type = genomic DNA
gacccagtggcctaatggataaggcatcagcctccggagctggggattgtgggttcgagtcccatctgggtcg

SEQ ID NO: 32 - DNA, 73 bp, Homo sapiens
  source 1..73: mol_type = genomic DNA
gccccagtggcctaatggataaggcactggcctcctaagccagggattgtgggttcgagtcccacctggggta

SEQ ID NO: 33 - DNA, 73 bp, Homo sapiens
  source 1..73: mol_type = genomic DNA
gccccagtggcctaatggataaggcactggcctcctaagccagggattgtgggttcgagtcccacctggggtg

SEQ ID NO: 34 - DNA, 73 bp, Homo sapiens
  source 1..73: mol_type = genomic DNA
gccccggtggcctaatggataaggcattggcctcctaagccagggattgtgggttcgagtcccacccggggta

SEQ ID NO: 35 - DNA, 73 bp, Homo sapiens
  source 1..73: mol_type = genomic DNA
gccccagtggcctaatggataaggcattggcctcctaagccagggattgtgggttcgagtcccatctggggtg

SEQ ID NO: 36 - DNA, 73 bp, Homo sapiens
  source 1..73: mol_type = genomic DNA
gccccagtggcctgatggataaggtactggcctcctaagccagggattgtgggttcgagttccacctggggta

SEQ ID NO: 37 - DNA, 73 bp, Homo sapiens
  source 1..73: mol_type = genomic DNA
ggccgcgtggcctaatggataaggcgtctgacttcggatcagaagattgcaggttcgagtcctgccgcggtcg

SEQ ID NO: 38 - DNA, 73 bp, Homo sapiens
  source 1..73: mol_type = genomic DNA
gaccacgtggcctaatggataaggcgtctgacttcggatcagaagattgagggttcgaatccctccgtggtta

SEQ ID NO: 39 - DNA, 73 bp, Homo sapiens
  source 1..73: mol_type = genomic DNA
gaccgcgtggcctaatggataaggcgtctgacttcggatcagaagattgagggttcgagtcccttcgtggtcg

SEQ ID NO: 40 - DNA, 73 bp, Homo sapiens
  source 1..73: mol_type = genomic DNA
gaccacgtggcctaatggataaggcgtctgacttcggatcagaagattgagggttcgaatcccttcgtggtta

SEQ ID NO: 41 - DNA, 73 bp, Homo sapiens
  source 1..73: mol_type = genomic DNA
gaccacgtggcctaatggataaggcgtctgacttcggatcagaagattgagggttcgaatcccttcgtggttg

SEQ ID NO: 42 - DNA, 73 bp, Homo sapiens
  source 1..73: mol_type = genomic DNA
ggccgtgtggcctaatggataaggcgtctgacttcggatcaaaagattgcaggtttgagttctgccacggtcg

SEQ ID NO: 43 - DNA, 85 bp, Homo sapiens
  source 1..85: mol_type = genomic DNA
ggctccgtggcgcaatggatagcgcattggacttctagaggctgaaggcattcaaaggttccgggttcgagtcccggcggagtcg

SEQ ID NO: 44 - DNA, 88 bp, Homo sapiens
  source 1..88: mol_type = genomic DNA
ggctctgtggcgcaatggatagcgcattggacttctagtgacgaatagagcaattcaaaggttgtgggttcgaatcccaccagagtcg

SEQ ID NO: 45 - DNA, 91 bp, Homo sapiens
  source 1..91: mol_type = genomic DNA
ggctctgtggcgcaatggatagcgcattggacttctagctgagcctagtgtggtcattcaaaggttgtgggttcgagtcccaccagagtcg

SEQ ID NO: 46 - DNA, 86 bp, Homo sapiens
  source 1..86: mol_type = genomic DNA
ggctctgtggcgcaatggatagcgcattggacttctagatagttagagaaattcaaaggttgtgggttcgagtcccaccagagtcg

SEQ ID NO: 47 - DNA, 74 bp, Homo sapiens
  source 1..74: mol_type = genomic DNA
gtctctgtggcgcaatggacgagcgcgctggacttctaatccagaggttccgggttcgagtcccggcagagatg

SEQ ID NO: 48 - DNA, 87 bp, Homo sapiens
  source 1..87: mol_type = genomic DNA
ggctctgtggcgcaatggatagcgcattggacttctagcctaaatcaagagattcaaaggttgcgggttcgagtccctccagagtcg

SEQ ID NO: 49 - DNA, 74 bp, Homo sapiens
  source 1..74: mol_type = genomic DNA
gtctctgtggcgcaatcggttagcgcgttcggctgttaaccgaaaggttggtggttcgatcccacccagggacg

SEQ ID NO: 50 - DNA, 74 bp, Homo sapiens
  source 1..74: mol_type = genomic DNA
gtctctgtggcgcaatcggctagcgcgtttggctgttaactaaaaggttggcggttcgaacccacccagaggcg

SEQ ID NO: 51 - DNA, 74 bp, Homo sapiens
  source 1..74: mol_type = genomic DNA
gtctctgtggtgcaatcggttagcgcgttccgctgttaaccgaaagcttggtggttcgagcccacccagggatg

SEQ ID NO: 52 - DNA, 74 bp, Homo sapiens
  source 1..74: mol_type = genomic DNA
gtctctgtggcgcaatcggctagcgcgtttggctgttaactaaaaagttggtggttcgaacacacccagaggcg

SEQ ID NO: 53 - DNA, 74 bp, Homo sapiens
  source 1..74: mol_type = genomic DNA
gtctctgtggcgcaatcggttagcgcgttcggctgttaaccgaaaggttggtggttcgagcccacccagggacg

SEQ ID NO: 54 - DNA, 74 bp, Homo sapiens
  source 1..74: mol_type = genomic DNA
gtctctgtggcgcaatcggttagcgcattcggctgttaaccgaaaggttggtggttcgagcccacccagggacg

SEQ ID NO: 55 - DNA, 74 bp, Homo sapiens
  source 1..74: mol_type = genomic DNA
gtctctgtggcgcaatcggttagcgcgttcggctgttaaccgaaagattggtggttcgagcccacccagggacg

SEQ ID NO: 56 - DNA, 74 bp, Homo sapiens
  source 1..74: mol_type = genomic DNA
gtctctgtggcgcaatcggttagcgcgttcggctgttaactgaaaggttggtggttcgagcccacccagggacg

SEQ ID NO: 57 - DNA, 74 bp, Homo sapiens
  source 1..74: mol_type = genomic DNA
gtctctgtggcgcaatgggttagcgcgttcggctgttaaccgaaaggttggtggttcgagcccatccagggacg

SEQ ID NO: 58 - DNA, 74 bp, Homo sapiens
  source 1..74: mol_type = genomic DNA
gtctctgtggcgtagtcggttagcgcgttcggctgttaaccgaaaagttggtggttcgagcccacccaggaacg

SEQ ID NO: 59 - DNA, 74 bp, Homo sapiens
  source 1..74: mol_type = genomic DNA
gtctctgtggcgcaatcggctagcgcgtttggctgttaactaaaaggttggtggttcgaacccacccagaggcg

SEQ ID NO: 60 - DNA, 74 bp, Homo sapiens
  source 1..74: mol_type = genomic DNA
gtctctgtggcgcaatcggttagcgcgttcggctgttaactgaaaggttagtggttcgagcccacccggggacg

SEQ ID NO: 61 - DNA, 72 bp, Homo sapiens
  source 1..72: mol_type = genomic DNA
tcctcgttagtatagtggttagtatccccgcctgtcacgcgggagaccggggttcaattccccgacggggag

SEQ ID NO: 62 - DNA, 72 bp, Homo sapiens
  source 1..72: mol_type = genomic DNA
tcctcgttagtatagtggtgagtatccccgcctgtcacgcgggagaccggggttcgattccccgacggggag

SEQ ID NO: 63 - DNA, 72 bp, Homo sapiens
  source 1..72: mol_type = genomic DNA
tcctcgttagtatagtggtgagtgtccccgtctgtcacgcgggagaccggggttcgattccccgacggggag

SEQ ID NO: 64 - DNA, 72 bp, Homo sapiens
  source 1..72: mol_type = genomic DNA
gggggcatagctcagtggtagagcatttgactgcagatcaagaggtccctggttcaaatccaggtgccccct

SEQ ID NO: 65 - DNA, 72 bp, Homo sapiens
  source 1..72: mol_type = genomic DNA
gggggtatagctcaggggtagagcatttgactgcagatcaagaggtccctggttcaaatccaggtgcccccc

SEQ ID NO: 66 - DNA, 72 bp, Homo sapiens
  source 1..72: mol_type = genomic DNA
gggggtatagcttagcggtagagcatttgactgcagatcaagaggtccccggttcaaatccgggtgccccct

SEQ ID NO: 67 - DNA, 72 bp, Homo sapiens
  source 1..72: mol_type = genomic DNA
gggggtatagcttaggggtagagcatttgactgcagatcaaaaggtccctggttcaaatccaggtgcccctt

SEQ ID NO: 68 - DNA, 72 bp, Homo sapiens
  source 1..72: mol_type = genomic DNA
gggggtatagctcaggggtagagcatttgactgcagatcaagaggtccccagttcaaatctgggtgccccct

SEQ ID NO: 69 - DNA, 72 bp, Homo sapiens
  source 1..72: mol_type = genomic DNA
gggggtatagctcaggggtagagcatttgactgcagatcaagaagtccccggttcaaatccgggtgccccct

SEQ ID NO: 70 - DNA, 72 bp, Homo sapiens
  source 1..72: mol_type = genomic DNA
gggggtatagctcaggggtagagcatttgactgcagatcaagaggtctctggttcaaatccaggtgccccct

SEQ ID NO: 71 - DNA, 72 bp, Homo sapiens
  source 1..72: mol_type = genomic DNA
gggggtatagctcaggggtagagcacttgactgcagatcaagaagtccttggttcaaatccaggtgccccct

SEQ ID NO: 72 - DNA, 72 bp, Homo sapiens
  source 1..72: mol_type = genomic DNA
ggggatatagctcaggggtagagcatttgactgcagatcaagaggtccccggttcaaatccgggtgcccccc

SEQ ID NO: 73 - DNA, 72 bp, Homo sapiens
  source 1..72: mol_type = genomic DNA
gggggtatagttcaggggtagagcatttgactgcagatcaagaggtccctggttcaaatccaggtgccccct

SEQ ID NO: 74 - DNA, 72 bp, Homo sapiens
  source 1..72: mol_type = genomic DNA
gggggtatagctcaggggtagagcatttgactgcaaatcaagaggtccctgattcaaatccaggtgccccct

SEQ ID NO: 75 - DNA, 72 bp, Homo sapiens
  source 1..72: mol_type = genomic DNA
gggggtatagctcagtggtagagcatttgactgcagatcaagaggtccccggttcaaatccgggtgccccct

SEQ ID NO: 76 - DNA, 72 bp, Homo sapiens
  source 1..72: mol_type = genomic DNA
gggcgtatagctcaggggtagagcatttgactgcagatcaagaggtccccagttcaaatctgggtgccccct

SEQ ID NO: 77 - DNA, 72 bp, Homo sapiens
  source 1..72: mol_type = genomic DNA
gggggtatagctcacaggtagagcatttgactgcagatcaagaggtccccggttcaaatctgggtgccccct

SEQ ID NO: 78 - DNA, 70 bp, Homo sapiens
  source 1..70: mol_type = genomic DNA
gggcgtatagctcaggggtagagcatttgactgcagatcaagaggtccccagttcaaatctgggtgccca

SEQ ID NO: 79 - DNA, 72 bp, Homo sapiens
  source 1..72: mol_type = genomic DNA
gggggtatagctcacaggtagagcatttgactgcagatcaagaggtccccggttcaaatccggttactccct

SEQ ID NO: 80 - DNA, 72 bp, Homo sapiens
  source 1..72: mol_type = genomic DNA
gggggtatagctcaggggtagagcacttgactgcagatcaagaggtccctggttcaaatccaggtgccccct

SEQ ID NO: 81 - DNA, 72 bp, Homo sapiens
  source 1..72: mol_type = genomic DNA
gggggtatagctcagtggtagagcatttgactgcagatcaagaggtccctggttcaaatccgggtgccccct

SEQ ID NO: 82 - DNA, 73 bp, Homo sapiens
  source 1..73: mol_type = genomic DNA
gggggtatagctcagtgggtagagcatttgactgcagatcaagaggtccccggttcaaatccgggtgccccct

SEQ ID NO: 83 - DNA, 72 bp, Homo sapiens
  source 1..72: mol_type = genomic DNA
gggggtgtagctcagtggtagagcatttgactgcagatcaagaggtccctggttcaaatccaggtgccccct

SEQ ID NO: 84 - DNA, 73 bp, Homo sapiens
  source 1..73: mol_type = genomic DNA
gggggtatagctcaggtggtagagcatttgactgcagatcaagaggtccccggttcaaatccgggtgccccct

SEQ ID NO: 85 - DNA, 72 bp, Homo sapiens
  source 1..72: mol_type = genomic DNA
gggggtatagctcaggggtagagcatttgactgcagatcaagaggtccccggttcaaatccgggtgccccct

SEQ ID NO: 86 - DNA, 72 bp, Homo sapiens
  source 1..72: mol_type = genomic DNA
gggggtatagctcaggggtagagcatttgactgcagatcaagaggtccctggttcaaatccaggtgccccct

SEQ ID NO: 87 - DNA, 72 bp, Homo sapiens
  source 1..72: mol_type = genomic DNA
ggttccatggtgtaatggttagcactctggactctgaatccagcgatccgagttcaaatctcggtggaacct

SEQ ID NO: 88 - DNA, 72 bp, Homo sapiens
  source 1..72: mol_type = genomic DNA
ggttccatggtgtaatggttagcactctggactctgaatccagcgatccgagttcaagtctcggtggaacct

SEQ ID NO: 89 - DNA, 72 bp, Homo sapiens
  source 1..72: mol_type = genomic DNA
ggttccatggtgtaatggtgagcactctggactctgaatccagcgatccgagttcgagtctcggtggaacct

SEQ ID NO: 90 - DNA, 72 bp, Homo sapiens
  source 1..72: mol_type = genomic DNA
ggttccatggtgtaatggtaagcactctggactctgaatccagcgatccgagttcgagtctcggtggaacct

SEQ ID NO: 91 - DNA, 72 bp, Homo sapiens
  source 1..72: mol_type = genomic DNA
ggttccatggtgtaatggttagcactctggactctgaatccggtaatccgagttcaaatctcggtggaacct

SEQ ID NO: 92 - DNA, 72 bp, Homo sapiens
  source 1..72: mol_type = genomic DNA
ggccccatggtgtaatggtcagcactctggactctgaatccagcgatccgagttcaaatctcggtgggaccc

SEQ ID NO: 93 - DNA, 72 bp, Homo sapiens
  source 1..72: mol_type = genomic DNA
ggttccatggtgtaatggtaagcactctggactctgaatccagccatctgagttcgagtctctgtggaacct

SEQ ID NO: 94 - DNA, 72 bp, Homo sapiens
  source 1..72: mol_type = genomic DNA
ggtcccatggtgtaatggttagcactctggactttgaatccagcgatccgagttcaaatctcggtgggacct

SEQ ID NO: 95 - DNA, 72 bp, Homo sapiens
  source 1..72: mol_type = genomic DNA
ggtcccatggtgtaatggttagcactctggactttgaatccagcaatccgagttcgaatctcggtgggacct

SEQ ID NO: 96 - DNA, 72 bp, Homo sapiens
  source 1..72: mol_type = genomic DNA
ggccccatggtgtaatggttagcactctggactttgaatccagcgatccgagttcaaatctcggtgggacct

SEQ ID NO: 97 - DNA, 72 bp, Homo sapiens
  source 1..72: mol_type = genomic DNA
ggtcccatggtgtaatggttagcactctgggctttgaatccagcaatccgagttcgaatcttggtgggacct

SEQ ID NO: 98 - DNA, 72 bp, Homo sapiens
  source 1..72: mol_type = genomic DNA
tccctggtggtctagtggttaggattcggcgctctcaccgccgcggcccgggttcgattcccggtcagggaa

SEQ ID NO: 99 - DNA, 72 bp, Homo sapiens
  source 1..72: mol_type = genomic DNA
tccctggtggtctagtggttaggattcggcgctctcaccgccgcggcccgggttcgattcccggtcaggaaa

SEQ ID NO: 100 - DNA, 72 bp, Homo sapiens
  source 1..72: mol_type = genomic DNA
tcccatatggtctagcggttaggattcctggttttcacccaggtggcccgggttcgactcccggtatgggaa

SEQ ID NO: 101 - DNA, 72 bp, Homo sapiens
  source 1..72: mol_type = genomic DNA
tcccacatggtctagcggttaggattcctggttttcacccaggcggcccgggttcgactcccggtgtgggaa

SEQ ID NO: 102 - DNA, 72 bp, Homo sapiens
  source 1..72: mol_type = genomic DNA
tccctggtggtctagtggctaggattcggcgctttcaccgccgcggcccgggttcgattcccggccagggaa

SEQ ID NO: 103 - DNA, 72 bp, Homo sapiens
  source 1..72: mol_type = genomic DNA
tccctggtggtctagtggctaggattcggcgctttcaccgccgcggcccgggttcgattcccggtcagggaa

SEQ ID NO: 104 - DNA, 71 bp, Homo sapiens
  source 1..71: mol_type = genomic DNA
gcattggtggttcagtggtagaattctcgcctcccacgcgggagacccgggttcaattcccggccaatgca

SEQ ID NO: 105 - DNA, 71 bp, Homo sapiens
  source 1..71: mol_type = genomic DNA
gcgccgctggtgtagtggtatcatgcaagattcccattcttgcgacccgggttcgattcccgggcggcgca

SEQ ID NO: 106 - DNA, 71 bp, Homo sapiens
  source 1..71: mol_type = genomic DNA
gcattggtggttcaatggtagaattctcgcctcccacgcaggagacccaggttcgattcctggccaatgca

SEQ ID NO: 107 - DNA, 71 bp, Homo sapiens
  source 1..71: mol_type = genomic DNA
gcatgggtggttcagtggtagaattctcgcctgccacgcgggaggcccgggttcgattcccggcccatgca

SEQ ID NO: 108 - DNA, 71 bp, Homo sapiens
  source 1..71: mol_type = genomic DNA
gcattggtggttcagtggtagaattctcgcctgccacgcgggaggcccgggttcgattcccggccaatgca

SEQ ID NO: 109 - DNA, 71 bp, Homo sapiens
  source 1..71: mol_type = genomic DNA
gcattggtggttcagtggtagaattctcgcctgccacgcgggaggcccgggtttgattcccggccagtgca

SEQ ID NO: 110 - DNA, 71 bp, Homo sapiens
  source 1..71: mol_type = genomic DNA
gcataggtggttcagtggtagaattcttgcctgccacgcaggaggcccaggtttgattcctggcccatgca

SEQ ID NO: 111 - DNA, 71 bp, Homo sapiens
  source 1..71: mol_type = genomic DNA
gcattggtggttcagtggtagaattctcgcctgccatgcgggcggccgggcttcgattcctggccaatgca

SEQ ID NO: 112 - DNA, 72 bp, Homo sapiens
  source 1..72: mol_type = genomic DNA
gcgttggtggtatagtggttagcatagctgccttccaagcagttgacccgggttcgattcccggccaacgca

SEQ ID NO: 113 - DNA, 72 bp, Homo sapiens
  source 1..72: mol_type = genomic DNA
gcgttggtggtatagtggtgagcatagctgccttccaagcagttgacccgggttcgattcccggccaacgca

SEQ ID NO: 114 - DNA, 72 bp, Homo sapiens
  source 1..72: mol_type = genomic DNA
gcgttggtggtatagtggtaagcatagctgccttccaagcagttgacccgggttcgattcccggccaacgca

SEQ ID NO: 115 - DNA, 72 bp, Homo sapiens
  source 1..72: mol_type = genomic DNA
gcgttggtggtatagtggtgagcatagttgccttccaagcagttgacccgggctcgattcccgcccaacgca

SEQ ID NO: 116 - DNA, 72 bp, Homo sapiens
  source 1..72: mol_type = genomic DNA
gccgtgatcgtatagtggttagtactctgcgttgtggccgcagcaacctcggttcgaatccgagtcacggca

SEQ ID NO: 117 - DNA, 72 bp, Homo sapiens
  source 1..72: mol_type = genomic DNA
gccatgatcgtatagtggttagtactctgcgctgtggccgcagcaacctcggttcgaatccgagtcacggca

SEQ ID NO: 118 - DNA, 74 bp, Homo sapiens
  source 1..74: mol_type = genomic DNA
ggccggttagctcagttggttagagcgtggcgctaataacgccaaggtcgcgggttcgatccccgtacgggcca

SEQ ID NO: 119 - DNA, 74 bp, Homo sapiens
  source 1..74: mol_type = genomic DNA
ggccggttagctcagttggttagagcgtggtgctaataacgccaaggtcgcgggttcgatccccgtactggcca

SEQ ID NO: 120 - DNA, 74 bp, Homo sapiens
  source 1..74: mol_type = genomic DNA
ggctggttagctcagttggttagagcgtggtgctaataacgccaaggtcgcgggttcgatccccgtactggcca

SEQ ID NO: 121 - DNA, 74 bp, Homo sapiens
  source 1..74: mol_type = genomic DNA
ggccggttagctcagttggttagagcgtggtgctaataacgccaaggtcgcgggttcgaaccccgtacgggcca

SEQ ID NO: 122 - DNA, 74 bp, Homo sapiens
  source 1..74: mol_type = genomic DNA
ggccggttagctcagttggttagagcgtggtgctaataacgccaaggtcgcgggttcgatccccgtacgggcca

SEQ ID NO: 123 - DNA, 74 bp, Homo sapiens
  source 1..74: mol_type = genomic DNA
ggccggttagctcagttggttagagcgtggtgctaataacgctaaggtcgcgggttcgatccccgtactggcca

SEQ ID NO: 124 - DNA, 74 bp, Homo sapiens
  source 1..74: mol_type = genomic DNA
ggccggttagctcagttggtcagagcgtggtgctaataacgccaaggtcgcgggttcgatccccgtacgggcca

SEQ ID NO: 125 - DNA, 74 bp, Homo sapiens
  source 1..74: mol_type = genomic DNA
ggccggttagctcagtcggctagagcgtggtgctaataacgccaaggtcgcgggttcgatccccgtacgggcca

SEQ ID NO: 126 - DNA, 74 bp, Homo sapiens
  source 1..74: mol_type = genomic DNA
ggctggttagttcagttggttagagcgtggtgctaataacgccaaggtcgtgggttcgatccccatatcggcca

SEQ ID NO: 127 - DNA, 74 bp, Homo sapiens
  source 1..74: mol_type = genomic DNA
ggccggttagctcagttggtaagagcgtggtgctgataacaccaaggtcgcgggctcgactcccgcaccggcca

SEQ ID NO: 128 - DNA, 93 bp, Homo sapiens
  source 1..93: mol_type = genomic DNA
gctccagtggcgcaatcggttagcgcgcggtacttatatgacagtgcgagcggagcaatgccgaggttgtgagttcgatcctcacctggagca

SEQ ID NO: 129 - DNA, 93 bp, Homo sapiens
  source 1..93: mol_type = genomic DNA
gctccagtggcgcaatcggttagcgcgcggtacttatacagcagtacatgcagagcaatgccgaggttgtgagttcgagcctcacctggagca

SEQ ID NO: 130 - DNA, 94 bp, Homo sapiens
  source 1..94: mol_type = genomic DNA
gctccagtggcgcaatcggttagcgcgcggtacttatatggcagtatgtgtgcgagtgatgccgaggttgtgagttcgagcctcacctggagca

SEQ ID NO: 131 - DNA, 94 bp, Homo sapiens
  source 1..94: mol_type = genomic DNA
gctccagtggcgcaatcggttagcgcgcggtacttatacaacagtatatgtgcgggtgatgccgaggttgtgagttcgagcctcacctggagca

SEQ ID NO: 132 - DNA, 94 bp, Homo sapiens
  source 1..94: mol_type = genomic DNA
gctccagtggcgcaatcggttagcgcgcggtacttataagacagtgcacctgtgagcaatgccgaggttgtgagttcaagcctcacctggagca

SEQ ID NO: 133 - DNA, 82 bp, Homo sapiens
  source 1..82: mol_type = genomic DNA
ggtagcgtggccgagcggtctaaggcgctggattaaggctccagtctcttcggaggcgtgggttcgaatcccaccgctgcca

SEQ ID NO: 134 - DNA, 82 bp, Homo sapiens
  source 1..82: mol_type = genomic DNA
ggtagcgtggccgagcggtctaaggcgctggattaaggctccagtctcttcgggggcgtgggttcgaatcccaccgctgcca

SEQ ID NO: 135 - DNA, 82 bp, Homo sapiens
  source 1..82: mol_type = genomic DNA
ggtagcgtggccgagcggtctaaggcgctggattaaggctccagtctcttcgggggcgtgggttcaaatcccaccgctgcca

SEQ ID NO: 136 - DNA, 82 bp, Homo sapiens
  source 1..82: mol_type = genomic DNA
ggtagcgtggccgagtggtctaagacgctggattaaggctccagtctcttcgggggcgtgggtttgaatcccaccgctgcca

SEQ ID NO: 137 - DNA, 106 bp, Homo sapiens
  source 1..106: mol_type = genomic DNA
gtcaggatggccgagtggtctaaggcgccagactcaagctaagcttcctccgcggtggggattctggtctccaatggaggcgtgggttcgaatcccacttctgaca

SEQ ID NO: 138 - DNA, 105 bp, Homo sapiens
  source 1..105: mol_type = genomic DNA
gtcaggatggccgagtggtctaaggcgccagactcaagcttggcttcctcgtgttgaggattctggtctccaatggaggcgtgggttcgaatcccacttctgaca

SEQ ID NO: 139 - DNA, 108 bp, Homo sapiens
  source 1..108: mol_type = genomic DNA
gtcaggatggccgagtggtctaaggcgccagactcaagcttactgcttcctgtgttcgggtcttctggtctccgtatggaggcgtgggttcgaatcccacttctgaca

SEQ ID NO: 140 - DNA, 107 bp, Homo sapiens
  source 1..107: mol_type = genomic DNA
gtcaggatggccgagtggtctaaggcgccagactcaagttgctacttcccaggtttggggcttctggtctccgcatggaggcgtgggttcgaatcccacttctgaca

SEQ ID NO: 141 - DNA, 106 bp, Homo sapiens
  source 1..106: mol_type = genomic DNA
gtcaggatggccgagtggtctaaggcgccagactcaaggtaagcaccttgcctgcgggctttctggtctccggatggaggcgtgggttcgaatcccacttctgaca

SEQ ID NO: 142 - DNA, 74 bp, Homo sapiens
  source 1..74: mol_type = genomic DNA
gcctccttagtgcagtaggtagcgcatcagtctcaaaatctgaatggtcctgagttcaagcctcagagggggca

SEQ ID NO: 143 - DNA, 84 bp, Homo sapiens
  source 1..84: mol_type = genomic DNA
gtcaggatggccgagcagtcttaaggcgctgcgttcaaatcgcaccctccgctggaggcgtgggttcgaatcccacttttgaca

SEQ ID NO: 144 - DNA, 83 bp, Homo sapiens
  source 1..83: mol_type = genomic DNA
gtcaggatggccgagcggtctaaggcgctgcgttcaggtcgcagtctcccctggaggcgtgggttcgaatcccactcctgaca

SEQ ID NO: 145 - DNA, 83 bp, Homo sapiens
  source 1..83: mol_type = genomic DNA
gtcaggatggccgagcggtctaaggcgctgcgttcaggtcgcagtctcccctggaggcgtgggttcgaatcccacttctgaca

SEQ ID NO: 146 - DNA, 83 bp, Homo sapiens
  source 1..83: mol_type = genomic DNA
accaggatggccgagtggttaaggcgttggacttaagatccaatggacatatgtccgcgtgggttcgaaccccactcctggta

SEQ ID NO: 147 - DNA, 83 bp, Homo sapiens
  source 1..83: mol_type = genomic DNA
accgggatggccgagtggttaaggcgttggacttaagatccaatgggctggtgcccgcgtgggttcgaaccccactctcggta

SEQ ID NO: 148 - DNA, 83 bp, Homo sapiens
  source 1..83: mol_type = genomic DNA
accagaatggccgagtggttaaggcgttggacttaagatccaatggattcatatccgcgtgggttcgaaccccacttctggta

SEQ ID NO: 149 - DNA, 83 bp, Homo sapiens
  source 1..83: mol_type = genomic DNA
accgggatggctgagtggttaaggcgttggacttaagatccaatggacaggtgtccgcgtgggttcgagccccactcccggta

SEQ ID NO: 150 - DNA, 82 bp, Homo sapiens
  source 1..82: mol_type = genomic DNA
ggtagcgtggccgagcggtctaaggcgctggatttaggctccagtctcttcggaggcgtgggttcgaatcccaccgctgcca

SEQ ID NO: 151 - DNA, 82 bp, Homo sapiens
  source 1..82: mol_type = genomic DNA
ggtagtgtggccgagcggtctaaggcgctggatttaggctccagtctcttcgggggcgtgggttcgaatcccaccactgcca

SEQ ID NO: 152 - DNA, 82 bp, Homo sapiens
  source 1..82: mol_type = genomic DNA
ggtagcgtggccgagtggtctaaggcgctggatttaggctccagtcatttcgatggcgtgggttcgaatcccaccgctgcca

SEQ ID NO: 153 - DNA, 73 bp, Homo sapiens
  source 1..73: mol_type = genomic DNA
gcccggctagctcagtcggtagagcatgggactcttaatcccagggtcgtgggttcgagccccacgttgggcg

SEQ ID NO: 154 - DNA, 73 bp, Homo sapiens
  source 1..73: mol_type = genomic DNA
gcccagctagctcagtcggtagagcataagactcttaatctcagggttgtggattcgtgccccatgctgggtg

SEQ ID NO: 155 - DNA, 74 bp, Homo sapiens
  source 1..74: mol_type = genomic DNA
gcagctagctcagtcggtagagcatgagactcttaatctcagggtcatgggttcgtgccccatgttgggtgcca

SEQ ID NO: 156 - DNA, 73 bp, Homo sapiens
  source 1..73: mol_type = genomic DNA
gcccggctagctcagtcggtagagcatgagactcttaatctcagggtcgtgggttcgagccccacgttgggcg

SEQ ID NO: 157 - DNA, 73 bp, Homo sapiens
  source 1..73: mol_type = genomic DNA
gcccggctagctcagtcggtagagcatgagacccttaatctcagggtcgtgggttcgagccccacgttgggcg

SEQ ID NO: 158 - DNA, 73 bp, Homo sapiens
  source 1..73: mol_type = genomic DNA
gcccggctagctcagtcggtagagcatgggactcttaatctcagggtcgtgggttcgagccccacgttgggcg

SEQ ID NO: 159 - DNA, 73 bp, Homo sapiens
  source 1..73: mol_type = genomic DNA
gcccggctagctcagtcgatagagcatgagactcttaatctcagggtcgtgggttcgagccgcacgttgggcg

SEQ ID NO: 160 - DNA, 73 bp, Homo sapiens
  source 1..73: mol_type = genomic DNA
gcccagctagctcagtcggtagagcatgagactcttaatctcagggtcatgggtttgagccccacgtttggtg

SEQ ID NO: 161 - DNA, 73 bp, Homo sapiens
  source 1..73: mol_type = genomic DNA
gcctggctagctcagtcggcaaagcatgagactcttaatctcagggtcgtgggctcgagctccatgttgggcg

SEQ ID NO: 162 - DNA, 73 bp, Homo sapiens
  source 1..73: mol_type = genomic DNA
gcccgactacctcagtcggtggagcatgggactcttcatcccagggttgtgggttcgagccccacattgggca

SEQ ID NO: 163 - DNA, 73 bp, Homo sapiens
  source 1..73: mol_type = genomic DNA
gcctggatagctcagttggtagagcatcagacttttaatctgagggtccagggttcaagtccctgttcaggca

SEQ ID NO: 164 - DNA, 73 bp, Homo sapiens
  source 1..73: mol_type = genomic DNA
acccagatagctcagtcagtagagcatcagacttttaatctgagggtccaaggttcatgtccctttttgggtg

SEQ ID NO: 165 - DNA, 73 bp, Homo sapiens
  source 1..73: mol_type = genomic DNA
gcctggatagctcagttggtagagcatcagacttttaatctgagggtccagggttcaagtccctgttcaggcg

SEQ ID NO: 166 - DNA, 73 bp, Homo sapiens
  source 1..73: mol_type = genomic DNA
gcccggatagctcagtcggtagagcatcagacttttaatctgagggtccagggttcaagtccctgttcgggcg

SEQ ID NO: 167 - DNA, 73 bp, Homo sapiens
  source 1..73: mol_type = genomic DNA
gcctggatagctcagtcggtagagcatcagacttttaatctgagggtccagggttcaagtccctgttcaggcg

SEQ ID NO: 168 - DNA, 73 bp, Homo sapiens
  source 1..73: mol_type = genomic DNA
gcccggatagctcagtcggtagagcatcagacttttaatctgagggtccggggttcaagtccctgttcgggcg

SEQ ID NO: 169 - DNA, 73 bp, Homo sapiens
  source 1..73: mol_type = genomic DNA
gcctgggtagctcagtcggtagagcatcagacttttaatctgagggtccagggttcaagtccctgtccaggcg

SEQ ID NO: 170 - DNA, 73 bp, Homo sapiens
  source 1..73: mol_type = genomic DNA
gcctggatagctcagttggtagaacatcagacttttaatctgacggtgcagggttcaagtccctgttcaggcg

SEQ ID NO: 171 - DNA, 73 bp, Homo sapiens
  source 1..73: mol_type = genomic DNA
gcctcgttagcgcagtaggtagcgcgtcagtctcataatctgaaggtcgtgagttcgatcctcacacggggca

SEQ ID NO: 172 - DNA, 73 bp, Homo sapiens
  source 1..73: mol_type = genomic DNA
gccctcttagcgcagtgggcagcgcgtcagtctcataatctgaaggtcctgagttcgagcctcagagagggca

SEQ ID NO: 173 - DNA, 73 bp, Homo sapiens
  source 1..73: mol_type = genomic DNA
gcctccttagcgcagtaggcagcgcgtcagtctcataatctgaaggtcctgagttcgaacctcagagggggca

SEQ ID NO: 174 - DNA, 73 bp, Homo sapiens
  source 1..73: mol_type = genomic DNA
gccctcttagcgcagcgggcagcgcgtcagtctcataatctgaaggtcctgagttcgagcctcagagagggca

SEQ ID NO: 175 - DNA, 73 bp, Homo sapiens
  source 1..73: mol_type = genomic DNA
gccctcttagcgcagctggcagcgcgtcagtctcataatctgaaggtcctgagttcaagcctcagagagggca

SEQ ID NO: 176 - DNA, 73 bp, Homo sapiens
  source 1..73: mol_type = genomic DNA
gcctcgttagcgcagtaggcagcgcgtcagtctcataatctgaaggtcgtgagttcgagcctcacacggggca

SEQ ID NO: 177 - DNA, 73 bp, Homo sapiens
  source 1..73: mol_type = genomic DNA
gccctcttagtgcagctggcagcgcgtcagtttcataatctgaaagtcctgagttcaagcctcagagagggca

SEQ ID NO: 178 - DNA, 73 bp, Homo sapiens
  source 1..73: mol_type = genomic DNA
gccgaaatagctcagttgggagagcgttagactgaagatctaaaggtccctggttcgatcccgggtttcggca

SEQ ID NO: 179 - DNA, 73 bp, Homo sapiens
  source 1..73: mol_type = genomic DNA
gccgaaatagctcagttgggagagcgttagactgaagatctaaaggtccctggttcaatcccgggtttcggca

SEQ ID NO: 180 - DNA, 73 bp, Homo sapiens
  source 1..73: mol_type = genomic DNA
gccgagatagctcagttgggagagcgttagactgaagatctaaaggtccctggttcaatcccgggtttcggca

SEQ ID NO: 181 - DNA, 74 bp, Homo sapiens
  source 1..74: mol_type = genomic DNA
gccgaaatagctcagttgggagagcgttagaccgaagatcttaaaggtccctggttcaatcccgggtttcggca

SEQ ID NO: 182 - DNA, 74 bp, Homo sapiens
  source 1..74: mol_type = genomic DNA
gctgaaatagctcagttgggagagcgttagactgaagatcttaaagttccctggttcaaccctgggtttcagcc

SEQ ID NO: 183 - DNA, 72 bp, Homo sapiens
  source 1..72: mol_type = genomic DNA
ggctcgttggtctaggggtatgattctcgcttaggatgcgagaggtcccgggttcaaatcccggacgagccc

SEQ ID NO: 184 - DNA, 72 bp, Homo sapiens
  source 1..72: mol_type = genomic DNA
ggctcgttggtctaggggtatgattctcgcttagggtgcgagaggtcccgggttcaaatcccggacgagccc

SEQ ID NO: 185 - DNA, 72 bp, Homo sapiens
  source 1..72: mol_type = genomic DNA
ggctcgttggtctaggggtatgattctcgcttcgggtgcgagaggtcccgggttcaaatcccggacgagccc

SEQ ID NO: 186 - DNA, 72 bp, Homo sapiens
  source 1..72: mol_type = genomic DNA
ggctcgttggtctaggggtatgattctcgcttcgggtgtgagaggtcccgggttcaaatcccggacgagccc

SEQ ID NO: 187 - DNA, 72 bp, Homo sapiens
  source 1..72: mol_type = genomic DNA
ggctcgttggtctagtggtatgattctcgctttgggtgcgagaggtcccgggttcaaatcccggacgagccc

SEQ ID NO: 188 - DNA, 72 bp, Homo sapiens
  source 1..72: mol_type = genomic DNA
ggctcgttggtctaggggtatgattctcggtttgggtccgagaggtcccgggttcaaatcccggacgagccc

SEQ ID NO: 189 - DNA, 72 bp, Homo sapiens
  source 1..72: mol_type = genomic DNA
ggctcgttggtctaggggtatgattctcgctttgggtgcgagaggtcccgggttcaaatcccggacgagccc

SEQ ID NO: 190 - DNA, 87 bp, Homo sapiens
  source 1..87: mol_type = genomic DNA
gcccggatgatcctcagtggtctggggtgcaggcttcaaacctgtagctgtctagcgacagagtggttcaattccacctttcgggcg

SEQ ID NO: 191 - DNA, 84 bp, Homo sapiens
  source 1..84: mol_type = genomic DNA
gctcggatgatcctcagtggtctggggtgcaggcttcaaacctgtagctgtctagtgacagagtggttcaattccacctttgta

SEQ ID NO: 192 - DNA, 82 bp, Homo sapiens
  source 1..82: mol_type = genomic DNA
gtagtcgtggccgagtggttaaggcgatggactagaaatccattggggtttccccgcgcaggttcgaatcctgccgactacg

SEQ ID NO: 193 - DNA, 82 bp, Homo sapiens
  source 1..82: mol_type = genomic DNA
gtagtcgtggccgagtggttaaggcgatggactagaaatccattggggtctccccgcgcaggttcgaatcctgccgactacg

SEQ ID NO: 194 - DNA, 82 bp, Homo sapiens
  source 1..82: mol_type = genomic DNA
gtagtcgtggccgagtggttaaggcgatggactagaaatccattggggtttccccacgcaggttcgaatcctgccgactacg

SEQ ID NO: 195 - DNA, 82 bp, Homo sapiens
  source 1..82: mol_type = genomic DNA
gtagtcgtggccgagtggttaaggtgatggactagaaacccattggggtctccccgcgcaggttcgaatcctgccgactacg

SEQ ID NO: 196 - DNA, 82 bp, Homo sapiens
  source 1..82: mol_type = genomic DNA
gctgtgatggccgagtggttaaggcgttggactcgaaatccaatggggtctccccgcgcaggttcgaatcctgctcacagcg

SEQ ID NO: 197 - DNA, 82 bp, Homo sapiens
  source 1..82: mol_type = genomic DNA
gctgtgatggccgagtggttaaggcgttggactcgaaatccaatggggtctccccgcgcaggttcaaatcctgctcacagcg

SEQ ID NO: 198 - DNA, 82 bp, Homo sapiens
  source 1..82: mol_type = genomic DNA
gctgtgatggccgagtggttaaggtgttggactcgaaatccaatgggggttccccgcgcaggttcaaatcctgctcacagcg

SEQ ID NO: 199 - DNA, 82 bp, Homo sapiens
  source 1..82: mol_type = genomic DNA
gtcacggtggccgagtggttaaggcgttggactcgaaatccaatggggtttccccgcacaggttcgaatcctgttcgtgacg

SEQ ID NO: 200 - DNA, 82 bp, Homo sapiens
  source 1..82: mol_type = genomic DNA
gacgaggtggccgagtggttaaggcgatggactgctaatccattgtgctctgcacgcgtgggttcgaatcccaccctcgtcg

SEQ ID NO: 201 - DNA, 82 bp, Homo sapiens
  source 1..82: mol_type = genomic DNA
gacgaggtggccgagtggttaaggcgatggactgctaatccattgtgctctgcacgcgtgggttcgaatcccaccttcgtcg

SEQ ID NO: 202 - DNA, 82 bp, Homo sapiens
  source 1..82: mol_type = genomic DNA
gacgaggtggccgagtggttaaggcgatggactgctaatccattgtgctttgcacgcgtgggttcgaatcccatcctcgtcg

SEQ ID NO: 203 - DNA, 82 bp, Homo sapiens
  source 1..82: mol_type = genomic DNA
gacgaggtggccgagtggttaaggcgatggactgctaatccattgtgctctgcacgcgtgggttcgaatcccatcctcgtcg

SEQ ID NO: 204 - DNA, 82 bp, Homo sapiens
  source 1..82: mol_type = genomic DNA
gacgaggtggccgagtggttaaggcgatggactgctaatccattgtgctctgcacacgtgggttcgaatcccatcctcgtcg

SEQ ID NO: 205 - DNA, 84 bp, Homo sapiens
  source 1..84: mol_type = genomic DNA
ggagaggcctggccgagtggttaaggcgatggactgctaatccattgtgctctgcacgcgtgggttcgaatcccatcctcgtcg

SEQ ID NO: 206 - DNA, 82 bp, Homo sapiens
  source 1..82: mol_type = genomic DNA
gcagcgatggccgagtggttaaggcgttggacttgaaatccaatggggtctccccgcgcaggttcgaaccctgctcgctgcg

SEQ ID NO: 207 - DNA, 82 bp, Homo sapiens
  source 1..82: mol_type = genomic DNA
gtagtcgtggccgagtggttaaggcgatggacttgaaatccattggggtttccccgcgcaggttcgaatcctgccgactacg

SEQ ID NO: 208 - DNA, 82 bp, Homo sapiens
  source 1..82: mol_type = genomic DNA
gtagtcgtggccgagtggttaaggcgatggacttgaaatccattggggtctccccgcgcaggttcgaatcctgccgactacg

SEQ ID NO: 209 - DNA, 82 bp, Homo sapiens
  source 1..82: mol_type = genomic DNA
gtagtcgtggccgagtggttaaggcgatggacttgaaatccattggggtttccccgcgcaggttcgaatcctgtcggctacg

SEQ ID NO: 210 - DNA, 74 bp, Homo sapiens
  source 1..74: mol_type = genomic DNA
ggcgccgtggcttagttggttaaagcgcctgtctagtaaacaggagatcctgggttcgaatcccagcggtgcct

SEQ ID NO: 211 - DNA, 74 bp, Homo sapiens
  source 1..74: mol_type = genomic DNA
ggctccgtggcttagctggttaaagcgcctgtctagtaaacaggagatcctgggttcgaatcccagcggggcct

SEQ ID NO: 212 - DNA, 74 bp, Homo sapiens
  source 1..74: mol_type = genomic DNA
ggctccgtagcttagttggttaaagcgcctgtctagtaaacaggagatcctgggttcgactcccagcggggcct

SEQ ID NO: 213 - DNA, 74 bp, Homo sapiens
  source 1..74: mol_type = genomic DNA
ggcttcgtggcttagctggttaaagcgcctgtctagtaaacaggagatcctgggttcgaatcccagcgaggcct

SEQ ID NO: 214 - DNA, 74 bp, Homo sapiens
  source 1..74: mol_type = genomic DNA
ggcgccgtggcttagctggttaaagcgcctgtctagtaaacaggagatcctgggttcgaatcccagcggtgcct

SEQ ID NO: 215 - DNA, 74 bp, Homo sapiens
  source 1..74: mol_type = genomic DNA
ggccctgtggcttagctggtcaaagcgcctgtctagtaaacaggagatcctgggttcgaatcccagcggggcct

SEQ ID NO: 216 - DNA, 74 bp, Homo sapiens
  source 1..74: mol_type = genomic DNA
ggctctatggcttagttggttaaagcgcctgtctcgtaaacaggagatcctgggttcgactcccagtggggcct

SEQ ID NO: 217 - DNA, 72 bp, Homo sapiens
  source 1..72: mol_type = genomic DNA
ggcgcggtggccaagtggtaaggcgtcggtctcgtaaaccgaagatcacgggttcgaaccccgtccgtgcct

SEQ ID NO: 218 - DNA, 74 bp, Homo sapiens
  source 1..74: mol_type = genomic DNA
ggctctgtggcttagttggctaaagcgcctgtctcgtaaacaggagatcctgggttcgaatcccagcggggcct

SEQ ID NO: 219 - DNA, 72 bp, Homo sapiens
  source 1..72: mol_type = genomic DNA
ggcgcggtggccaagtggtaaggcgtcggtctcgtaaaccgaagatcgcgggttcgaaccccgtccgtgcct

SEQ ID NO: 220 - DNA, 74 bp, Homo sapiens
  source 1..74: mol_type = genomic DNA
ggccctgtagctcagcggttggagcgctggtctcgtaaacctaggggtcgtgagttcaaatctcaccagggcct

SEQ ID NO: 221 - DNA, 74 bp, Homo sapiens
  source 1..74: mol_type = genomic DNA
ggctctatggcttagttggttaaagcgcctgtcttgtaaacaggagatcctgggttcgaatcccagtagagcct

SEQ ID NO: 222 - DNA, 73 bp, Homo sapiens
  source 1..73: mol_type = genomic DNA
ggctccatagctcagtggttagagcactggtcttgtaaaccaggggtcgcgagttcgatcctcgctggggcct

SEQ ID NO: 223 - DNA, 73 bp, Homo sapiens
  source 1..73: mol_type = genomic DNA
ggctccatagctcaggggttagagcgctggtcttgtaaaccaggggtcgcgagttcaattctcgctggggcct

SEQ ID NO: 224 - DNA, 73 bp, Homo sapiens
  source 1..73: mol_type = genomic DNA
ggctccatagctcaggggttagagcactggtcttgtaaaccaggggtcgcgagttcaaatctcgctggggcct

SEQ ID NO: 225 - DNA, 73 bp, Homo sapiens
  source 1..73: mol_type = genomic DNA
ggccctatagctcaggggttagagcactggtcttgtaaaccaggggtcgcgagttcaaatctcgctggggcct

SEQ ID NO: 226 - DNA, 72 bp, Homo sapiens
  source 1..72: mol_type = genomic DNA
ggctccatagctcaggggttagagcactggtcttgtaaaccagggtcgcgagttcaaatctcgctggggcct

SEQ ID NO: 227 - DNA, 72 bp, Homo sapiens
  source 1..72: mol_type = genomic DNA
ggcctcgtggcgcaacggtagcgcgtctgactccagatcagaaggttgcgtgttcaaatcacgtcggggtca

SEQ ID NO: 228 - DNA, 72 bp, Homo sapiens
  source 1..72: mol_type = genomic DNA
gacctcgtggcgcaatggtagcgcgtctgactccagatcagaaggttgcgtgttcaagtcacgtcggggtca

SEQ ID NO: 229 - DNA, 72 bp, Homo sapiens
  source 1..72: mol_type = genomic DNA
gacctcgtggcgcaacggtagcgcgtctgactccagatcagaaggttgcgtgttcaaatcacgtcggggtca

SEQ ID NO: 230 - DNA, 72 bp, Homo sapiens
  source 1..72: mol_type = genomic DNA
gacctcgtggcgcaacggtagcgcgtctgactccagatcagaaggctgcgtgttcgaatcacgtcggggtca

SEQ ID NO: 231 - DNA, 72 bp, Homo sapiens
  source 1..72: mol_type = genomic DNA
gacctcgtggcgcaacggcagcgcgtctgactccagatcagaaggttgcgtgttcaaatcacgtcggggtca

SEQ ID NO: 232 - DNA, 93 bp, Homo sapiens
  source 1..93: mol_type = genomic DNA
ccttcaatagttcagctggtagagcagaggactatagctacttcctcagtaggagacgtccttaggttgctggttcgattccagcttgaagga

SEQ ID NO: 233 - DNA, 91 bp, Homo sapiens
  source 1..91: mol_type = genomic DNA
ccttcgatagctcagttggtagagcggaggactgtagttggctgtgtccttagacatccttaggtcgctggttcgaatccggctcgaagga

SEQ ID NO: 234 - DNA, 89 bp, Homo sapiens
  source 1..89: mol_type = genomic DNA
ccttcgatagctcagttggtagagcggaggactgtagtggatagggcgtggcaatccttaggtcgctggttcgattccggctcgaagga

SEQ ID NO: 235 - DNA, 89 bp, Homo sapiens
  source 1..89: mol_type = genomic DNA
ccttcgatagctcagttggtagagcggaggactgtaggctcattaagcaaggtatccttaggtcgctggttcgaatccggctcggagga

SEQ ID NO: 236 - DNA, 94 bp, Homo sapiens
  source 1..94: mol_type = genomic DNA
ccttcgatagctcagctggtagagcggaggactgtagattgtatagacatttgcggacatccttaggtcgctggttcgattccagctcgaagga

SEQ ID NO: 237 - DNA, 93 bp, Homo sapiens
  source 1..93: mol_type = genomic DNA
ccttcgatagctcagctggtagagcggaggactgtagctacttcctcagcaggagacatccttaggtcgctggttcgattccggctcgaagga

SEQ ID NO: 238 - DNA, 89 bp, Homo sapiens
  source 1..89: mol_type = genomic DNA
ccttcgatagctcagctggtagagcggaggactgtaggcgcgcgcccgtggccatccttaggtcgctggttcgattccggctcgaagga

SEQ ID NO: 239 - DNA, 94 bp, Homo sapiens
  source 1..94: mol_type = genomic DNA
ccttcgatagctcagctggtagagcggaggactgtagcctgtagaaacatttgtggacatccttaggtcgctggttcgattccggctcgaagga

SEQ ID NO: 240 - DNA, 94 bp, Homo sapiens
  source 1..94: mol_type = genomic DNA
ccttcgatagctcagctggtagagcggaggactgtagattgtacagacatttgcggacatccttaggtcgctggttcgattccggctcgaagga

SEQ ID NO: 241 - DNA, 89 bp, Homo sapiens
  source 1..89: mol_type = genomic DNA
ccttcgatagctcagctggtagagcggaggactgtagtacttaatgtgtggtcatccttaggtcgctggttcgattccggctcgaagga

SEQ ID NO: 242 - DNA, 89 bp, Homo sapiens
  source 1..89: mol_type = genomic DNA
ccttcgatagctcagctggtagagcggaggactgtaggggtttgaatgtggtcatccttaggtcgctggttcgaatccggctcggagga

SEQ ID NO: 243 - DNA, 94 bp, Homo sapiens
  source 1..94: mol_type = genomic DNA
ccttcgatagctcagctggtagagcggaggactgtagactgcggaaacgtttgtggacatccttaggtcgctggttcaattccggctcgaagga

SEQ ID NO: 244 - DNA, 90 bp, Homo sapiens
  source 1..90: mol_type = genomic DNA
ctttcgatagctcagttggtagagcggaggactgtaggttcattaaactaaggcatccttaggtcgctggttcgaatccggctcgaagga

SEQ ID NO: 245 - DNA, 88 bp, Homo sapiens
  source 1..88: mol_type = genomic DNA
tcttcaatagctcagctggtagagcggaggactgtaggtgcacgcccgtggccattcttaggtgctggtttgattccgacttggagag

SEQ ID NO: 246 - DNA, 73 bp, Homo sapiens
  source 1..73: mol_type = genomic DNA
gtttccgtagtgtagtggttatcacgttcgcctaacacgcgaaaggtccccggttcgaaaccgggcggaaaca

SEQ ID NO: 247 - DNA, 73 bp, Homo sapiens
  source 1..73: mol_type = genomic DNA
gtttccgtagtgtagtggtcatcacgttcgcctaacacgcgaaaggtccccggttcgaaaccgggcggaaaca

SEQ ID NO: 248 - DNA, 73 bp, Homo sapiens
  source 1..73: mol_type = genomic DNA
gtttccgtagtgtagtggttatcacgttcgcctaacacgcgaaaggtccctggatcaaaaccaggcggaaaca

SEQ ID NO: 249 - DNA, 73 bp, Homo sapiens
  source 1..73: mol_type = genomic DNA
gtttccgtagtgtagtggttatcacgttcgcctaacacgcgaaaggtccgcggttcgaaaccgggcggaaaca

SEQ ID NO: 250 - DNA, 73 bp, Homo sapiens
  source 1..73: mol_type = genomic DNA
gtttccgtagtgtagtggttatcacgtttgcctaacacgcgaaaggtccccggttcgaaaccgggcagaaaca

SEQ ID NO: 251 - DNA, 72 bp, Homo sapiens
  source 1..72: mol_type = genomic DNA
gggggtgtagctcagtggtagagcgtatgcttaacattcatgaggctctgggttcgatccccagcacttcca

SEQ ID NO: 252 - DNA, 73 bp, Homo sapiens
  source 1..73: mol_type = genomic DNA
gtttccgtagtgtagtggttatcacgttcgcctcacacgcgaaaggtccccggttcgaaaccgggcggaaaca

SEQ ID NO: 253 - DNA, 73 bp, Homo sapiens
  source 1..73: mol_type = genomic DNA
gcttctgtagtgtagtggttatcacgttcgcctcacacgcgaaaggtccccggttcgaaaccgggcagaagca

SEQ ID NO: 254 - DNA, 73 bp, Homo sapiens
  source 1..73: mol_type = genomic DNA
gtttccgtagtgtagcggttatcacattcgcctcacacgcgaaaggtccccggttcgatcccgggcggaaaca

SEQ ID NO: 255 - DNA, 73 bp, Homo sapiens
  source 1..73: mol_type = genomic DNA
gtttccgtagtgtagtggttatcacgttcgcctcacacgcgaaaggtccccggttcgaaactgggcggaaaca

SEQ ID NO: 256 - DNA, 74 bp, Homo sapiens
  source 1..74: mol_type = genomic DNA
gtttccgtagtgtagtggttatcacgttcgcctcacacgcgtaaaggtccccggttcgaaaccgggcggaaaca

SEQ ID NO: 257 - DNA, 73 bp, Homo sapiens
  source 1..73: mol_type = genomic DNA
gtttccgtagtggagtggttatcacgttcgcctcacacgcgaaaggtccccggtttgaaaccaggcggaaaca

SEQ ID NO: 258 - DNA, 73 bp, Homo sapiens
  source 1..73: mol_type = genomic DNA
ggttccatagtgtagtggttatcacgtctgctttacacgcagaaggtcctgggttcgagccccagtggaacca

SEQ ID NO: 259 - DNA, 73 bp, Homo sapiens
  source 1..73: mol_type = genomic DNA
ggttccatagtgtagcggttatcacgtctgctttacacgcagaaggtcctgggttcgagccccagtggaacca

SEQ ID NO: 260 - DNA, 73 bp, Homo sapiens
  source 1..73: mol_type = genomic DNA
ggttccatagtgtagtggttatcacatctgctttacacgcagaaggtcctgggttcaagccccagtggaacca

SEQ ID NO: 261 - DNA, 73 bp, Homo sapiens
  source 1..73: mol_type = genomic DNA
gtttccgtggtgtagtggttatcacattcgccttacacgcgaaaggtcctcgggtcgaaaccgagcggaaaca

SEQ ID NO: 262 - DNA, 72 bp, Homo sapiens
  source 1..72: mol_type = genomic DNA
agcagagtggcgcagcggaagcgtgctgggcccataacccagaggtcgatggatcgaaaccatcctctgcta

SEQ ID NO: 263 - DNA, 72 bp, Homo sapiens
  source 1..72: mol_type = genomic DNA
agcagagtggcgcagcggaagcgtgctgggcccataacccagaggtcgatggatctaaaccatcctctgcta

SEQ ID NO: 264 - DNA, 73 bp, Homo sapiens
  source 1..73: mol_type = genomic DNA
tccctggtggtctagtggctaggattcggcgctttcaccgccgcggcccgggttcgattcccggtcagggaat

SEQ ID NO: 265 - DNA, 72 bp, Homo sapiens
  source 1..72: mol_type = genomic DNA
gcgttggtggtttagtggtagaattctcgcctcccatgcgggagacccgggttcaattcccggccactgcac

SEQ ID NO: 266 - DNA, 72 bp, Homo sapiens
  source 1..72: mol_type = genomic DNA
ggccttggtggtgcagtggtagaattctcgcctcccacgtgggagacccgggttcaattcccggccaatgca

SEQ ID NO: 267 - DNA, 73 bp, Homo sapiens
  source 1..73: mol_type = genomic DNA
gtccctggtggtctagtggctaggattcggcgctttcaccgccgcggcccgggttcgattcccggccagggaa

SEQ ID NO: 268 - DNA, 75 bp, Homo sapiens
  source 1..75: mol_type = genomic DNA
tgtctctgtggcgcaatcggttagcgcgttcggctgttaaccgaaagattggtggttcgagcccacccagggacg

SEQ ID NO: 269 - DNA, 86 bp, Homo sapiens
  source 1..86: mol_type = genomic DNA
tggctccgtggcgcaatggatagcgcattggacttctagaggctgaaggcattcaaaggttccgggttcgagtcccggcggagtcg

SEQ ID NO: 270 - DNA, 74 bp, Homo sapiens
  source 1..74: mol_type = genomic DNA
gcccggctagctcagtcggtagagcatgagactcttaatctcagggtcgtgggttcgagccccacgttgggcgc

SEQ ID NO: 271 - DNA, 73 bp, Homo sapiens
  source 1..73: mol_type = genomic DNA
gccgtgatcgtatagtggttagtactctgcgttgtggccgcagcaacctcggttcgaatccgagtcacggcag

SEQ ID NO: 272 - DNA, 73 bp, Homo sapiens
  source 1..73: mol_type = genomic DNA
gcgttggtggtatagtggtgagcatagctgccttccaagcagttgacccgggttcgattcccggccaacgcag

SEQ ID NO: 273 - DNA, 73 bp, Homo sapiens
  source 1..73: mol_type = genomic DNA
tccctggtggtctagtggttaggattcggcgctctcaccgccgcggcccgggttcgattcccggtcagggaaa

SEQ ID NO: 274 - DNA, 73 bp, Homo sapiens
  source 1..73: mol_type = genomic DNA
aggttccatggtgtaatggtgagcactctggactctgaatccagcgatccgagttcgagtctcggtggaacct

SEQ ID NO: 275 - DNA, 75 bp, Homo sapiens
  source 1..75: mol_type = genomic DNA
tgtctctgtggcgtagtcggttagcgcgttcggctgttaaccgaaaagttggtggttcgagcccacccaggaacg

SEQ ID NO: 276 - DNA, 75 bp, Homo sapiens
  source 1..75: mol_type = genomic DNA
tgtctctgtggcgcaatcggttagcgcgttcggctgttaaccgaaaggttggtggttcgagcccacccagggacg

SEQ ID NO: 277 - DNA, 75 bp, Homo sapiens
  source 1..75: mol_type = genomic DNA
gtctctgtggcgcaatcggttagcgcattcggctgttaaccgaaaggttggtggttcgagcccacccagggacgc

SEQ ID NO: 278 - DNA, 75 bp, Homo sapiens
  source 1..75: mol_type = genomic DNA
gtctctgtggcgcaatgggttagcgcgttcggctgttaaccgaaaggttggtggttcgagcccatccagggacgc

SEQ ID NO: 279 - DNA, 72 bp, Homo sapiens
  source 1..72: mol_type = genomic DNA
gcactggtggttcagtggtagaattctcgcctcacacgcgggacacccgggttcaattcccggtcaaggcaa

SEQ ID NO: 280 - DNA, 74 bp, Homo sapiens
  source 1..74: mol_type = genomic DNA
gtttccgtagtgtagtggttatcacgttcgcctcacacgcgaaaggtccccggttcgaaactgggcggaaacag

SEQ ID NO: 281 - DNA, 72 bp, Homo sapiens
  source 1..72: mol_type = genomic DNA
gcactggtggttcagtggtagaattctcgcctcccacgcgggagacccgggtttaattcccggtcaagataa

SEQ ID NO: 282 - DNA, 75 bp, Homo sapiens
  source 1..75: mol_type = genomic DNA
gtttccgtagtgtagtggttatcacgttcgcctcacacgcgtaaaggtccccggttcgaaaccgggcggaaacat

SEQ ID NO: 283 - DNA, 73 bp, Homo sapiens
  source 1..73: mol_type = genomic DNA
tagcagagtggcgcagcggaagcgtgctgggcccataacccagaggtcgatggatcgaaaccatcctctgcta

SEQ ID NO: 284 - DNA, 74 bp, Homo sapiens
  source 1..74: mol_type = genomic DNA
gtttccgtagtgtagtggttatcacgttcgcctcacacgcgaaaggtccccggttcgaaaccgggcggaaacaa

SEQ ID NO: 285 - DNA, 73 bp, Homo sapiens
  source 1..73: mol_type = genomic DNA
tcctcgttagtatagtggtgagtatccccgcctgtcacgcgggagaccggggttcgattccccgacggggagg

SEQ ID NO: 286 - DNA, 72 bp, Homo sapiens
  source 1..72: mol_type = genomic DNA
tgcatgggtggttcagtggtagaattctcgcctgccacgcgggaggcccgggttcgattcccggcccatgca

SEQ ID NO: 287 - DNA, 73 bp, Homo sapiens
  source 1..73: mol_type = genomic DNA
tccctggtggtctagtggttaggattcggcgctctcaccgccgcggcccgggttcgattcccggtcagggaag

SEQ ID NO: 288 - DNA, 73 bp, Homo sapiens
  source 1..73: mol_type = genomic DNA
atccttgttactatagtggtgagtatctctgcctgtcatgcgtgagagagggggtcgattccccgacggggag

SEQ ID NO: 289 - DNA, 72 bp, Homo sapiens
  source 1..72: mol_type = genomic DNA
gcattggtggttcagtggtagaattctcgcctgccacgcgggaggcccgggttcgattcccggccaatgcac

SEQ ID NO: 290 - DNA, 84 bp, Homo sapiens
  source 1..84: mol_type = genomic DNA
gtcaggatggccgagcggtctaaggcgctgcgttcaggtcgcagtctcccctggaggcgtgggttcgaatcccactcctgacaa

SEQ ID NO: 291 - DNA, 73 bp, Homo sapiens
  source 1..73: mol_type = genomic DNA
cgcgttggtggtatagtggtgagcatagctgccttccaagcagttgacccgggttcgattcccggccaacgca

SEQ ID NO: 292 - DNA, 75 bp, Homo sapiens
  source 1..75: mol_type = genomic DNA
cgtctctgtggcgcaatcggttagcgcgttcggctgttaaccgaaaggttggtggttcgatcccacccagggacg

SEQ ID NO: 293 - DNA, 73 bp, Homo sapiens
  source 1..73: mol_type = genomic DNA
cgcgttggtggtgtagtggtgagcacagctgcctttcaagcagttaacgcgggttcgattcccgggtaacgaa

SEQ ID NO: 294 - DNA, 73 bp, Homo sapiens
  source 1..73: mol_type = genomic DNA
cggctcgttggtctaggggtatgattctcgcttcgggtgcgagaggtcccgggttcaaatcccggacgagccc

SEQ ID NO: 295 - DNA, 73 bp, Homo sapiens
  source 1..73: mol_type = genomic DNA
ggctcgttggtctaggggtatgattctcgcttagggtgcgagaggtcccgggttcaaatcccggacgagccct

SEQ ID NO: 296 - DNA, 74 bp, Homo sapiens
  source 1..74: mol_type = genomic DNA
cgcccggatagctcagtcggtagagcatcagacttttaatctgagggtccagggttcaagtccctgttcgggcg

SEQ ID NO: 297 - DNA, 74 bp, Homo sapiens
  source 1..74: mol_type = genomic DNA
gcccggatagctcagtcggtagagcatcagacttttaatctgagggtccagggttcaagtccctgttcgggcgt

SEQ ID NO: 298 - DNA, 107 bp, Homo sapiens
  source 1..107: mol_type = genomic DNA
tgtcaggatggccgagtggtctaaggcgccagactcaaggtaagcaccttgcctgcgggctttctggtctccggatggaggcgtgggttcgaatcccacttctgaca

SEQ ID NO: 299 - DNA, 73 bp, Homo sapiens
  source 1..73: mol_type = genomic DNA
ttccctggtggtctagtggttaggattcggcgctctcaccgccgcggcccgggttcgattcccggtcaggaaa

SEQ ID NO: 300 - DNA, 90 bp, Homo sapiens
  source 1..90: mol_type = genomic DNA
gccttcgatagctcagttggtagagcggaggactgtagtggatagggcgtggcaatccttaggtcgctggttcgattccggctcgaagga

SEQ ID NO: 301 - DNA, 74 bp, Homo sapiens
  source 1..74: mol_type = genomic DNA
cgggggattagctcaaatggtagagcgctcgcttagcatgcgagaggtagcgggatcgatgcccgcatcctcca

SEQ ID NO: 302 - DNA, 94 bp, Homo sapiens
  source 1..94: mol_type = genomic DNA
agctccagtggcgcaatcggttagcgcgcggtacttatacagcagtacatgcagagcaatgccgaggttgtgagttcgagcctcacctggagca

SEQ ID NO: 303 - DNA, 72 bp, Homo sapiens
  source 1..72: mol_type = genomic DNA
gcgccgctggtgtagtggtatcatgcaagattcccattcttgcgacccgggttcgattcccgggcggcgcat

SEQ ID NO: 304 - DNA, 73 bp, Homo sapiens
  source 1..73: mol_type = genomic DNA
tcccatatggtctagcggttaggattcctggttttcacccaggtggcccgggttcgactcccggtatgggaac

SEQ ID NO: 305 - DNA, 73 bp, Homo sapiens
  source 1..73: mol_type = genomic DNA
gggggatgtagctcagtggtagagcgcgcgcttcgcatgtgtgaggtcccgggttcaatccccggcatctcca

SEQ ID NO: 306 - DNA, 72 bp, Homo sapiens
  source 1..72: mol_type = genomic DNA
gcattggtggttcagtggtagaattctcgcctgccacgcgggaggcccgggttcgattcccggccaatgcaa

SEQ ID NO: 307 - DNA, 74 bp, Homo sapiens
  source 1..74: mol_type = genomic DNA
gggccagtggcgcaatggataacgcgtctgactacggatcagaagattctaggttcgactcctggctggctcgc

SEQ ID NO: 308 - DNA, 74 bp, Homo sapiens
  source 1..74: mol_type = genomic DNA
ggtttccgtagtgtagtggttatcacgttcgcctaacacgcgaaaggtccccggttcgaaaccgggcggaaaca

SEQ ID NO: 309 - DNA, 74 bp, Homo sapiens
  source 1..74: mol_type = genomic DNA
agtttccgtagtgtagtggttatcacgttcgcctaacacgcgaaaggtccccggttcgaaaccgggcggaaaca

SEQ ID NO: 310 - DNA, 83 bp, Homo sapiens
  source 1..83: mol_type = genomic DNA
aggtagcgtggccgagcggtctaaggcgctggattaaggctccagtctcttcgggggcgtgggttcgaatcccaccgctgcca

SEQ ID NO: 311 - DNA, 74 bp, Homo sapiens
  source 1..74: mol_type = genomic DNA
gtttccgtagtgtagtggtcatcacgttcgcctaacacgcgaaaggtccccggttcgaaaccgggcggaaacat

SEQ ID NO: 312 - DNA, 73 bp, Homo sapiens
  source 1..73: mol_type = genomic DNA
ggctcgttggtctaggggtatgattctcgctttgggtgcgagaggtcccgggttcaaatcccggacgagccca

SEQ ID NO: 313 - DNA, 73 bp, Homo sapiens
  source 1..73: mol_type = genomic DNA
ggctccatagctcaggggttagagcactggtcttgtaaaccagggtcgcgagttcaaatctcgctggggcctg

SEQ ID NO: 314 - DNA, 73 bp, Homo sapiens
  source 1..73: mol_type = genomic DNA
tggggatgtagctcagtggtagagcgcatgctttgcatgtatgaggccccgggttcgatccccggcatctcca

SEQ ID NO: 315 - DNA, 74 bp, Homo sapiens
  source 1..74: mol_type = genomic DNA
cgcccggctagctcagtcggtagagcatgagactcttaatctcagggtcgtgggttcgagccccacgttgggcg

SEQ ID NO: 316 - DNA, 74 bp, Homo sapiens
  source 1..74: mol_type = genomic DNA
gtttccgtagtgtagtggttatcacgttcgcctaacacgcgaaaggtccccggttcgaaaccgggcggaaacaa

SEQ ID NO: 317 - DNA, 74 bp, Homo sapiens
  source 1..74: mol_type = genomic DNA
gcccggctagctcagtcggtagagcatgagactcttaatctcagggtcgtgggttcgagccccacgttgggcgt

SEQ ID NO: 318 - DNA, 74 bp, Homo sapiens
  source 1..74: mol_type = genomic DNA
gtttccgtagtgtagtggttatcacgttcgcctcacacgcgaaaggtccccggttcgaaaccgggcggaaacac

SEQ ID NO: 319 - DNA, 73 bp, Homo sapiens
  source 1..73: mol_type = genomic DNA
cagcagagtggcgcagcggaagcgtgctgggcccataacccagaggtcgatggatcgaaaccatcctctgcta

SEQ ID NO: 320 - DNA, 85 bp, Homo sapiens
  source 1..85: mol_type = genomic DNA
ggagaggcctggccgagtggttaaggcgatggactgctaatccattgtgctctgcacgcgtgggttcgaatcccatcctcgtcgc

SEQ ID NO: 321 - DNA, 73 bp, Homo sapiens
  source 1..73: mol_type = genomic DNA
ggccccatggtgtaatggttagcactctggactttgaatccagcgatccgagttcaaatctcggtgggacctg

SEQ ID NO: 322 - DNA, 73 bp, Homo sapiens
  source 1..73: mol_type = genomic DNA
ggccccatggtgtaatggttagcactctggactttgaatccagcgatccgagttcaaatctcggtgggaccta

SEQ ID NO: 323 - DNA, 83 bp, Homo sapiens
  source 1..83: mol_type = genomic DNA
gtagtcgtggccgagtggttaaggcgatggacttgaaatccattggggtctccccgcgcaggttcgaatcctgccgactacgg

SEQ ID NO: 324 - DNA, 73 bp, Homo sapiens
  source 1..73: mol_type = genomic DNA
agcagagtggcgcagcggaagcgtgctgggcccataacccagaggtcgatggatcgaaaccatcctctgctat

SEQ ID NO: 325 - DNA, 74 bp, Homo sapiens
  source 1..74: mol_type = genomic DNA
ggaccacgtggcctaatggataaggcgtctgacttcggatcagaagattgagggttcgaatccctccgtggtta

SEQ ID NO: 326 - DNA, 83 bp, Homo sapiens
  source 1..83: mol_type = genomic DNA
tgtagtcgtggccgagtggttaaggcgatggactagaaatccattggggtctccccgcgcaggttcgaatcctgccgactacg

SEQ ID NO: 327 - DNA, 73 bp, Homo sapiens
  source 1..73: mol_type = genomic DNA
agcagagtggcgcagcggaagcgtgctgggcccataacccagaggtcgatggatcgaaaccatcctctgctag

SEQ ID NO: 328 - DNA, 84 bp, Homo sapiens
  source 1..84: mol_type = genomic DNA
cgtcaggatggccgagcggtctaaggcgctgcgttcaggtcgcagtctcccctggaggcgtgggttcgaatcccactcctgaca

SEQ ID NO: 329 - DNA, 75 bp, Homo sapiens
  source 1..75: mol_type = genomic DNA
ggctccgtggcttagctggttaaagcgcctgtctagtaaacaggagatcctgggttcgaatcccagcggggcctg

SEQ ID NO: 330 - DNA, 74 bp, Homo sapiens
  source 1..74: mol_type = genomic DNA
agggccagtggcgcaatggataacgcgtctgactacggatcagaagattccaggttcgactcctggctggctcg

SEQ ID NO: 331 - DNA, 74 bp, Homo sapiens
  source 1..74: mol_type = genomic DNA
ggtttccgtagtgtagtggttatcacgttcgcctcacacgcgaaaggtccccggttcgaaaccgggcggaaaca

SEQ ID NO: 332 - DNA, 73 bp, Homo sapiens
  source 1..73: mol_type = genomic DNA
aggggatgtagctcagtggtagagcgcatgcttcgcatgtatgaggtcccgggttcgatccccggcatctcca

SEQ ID NO: 333 - DNA, 75 bp, Homo sapiens
  source 1..75: mol_type = genomic DNA
tggccggttagctcagttggttagagcgtggtgctaataacgccaaggtcgcgggttcgatccccgtacgggcca

SEQ ID NO: 334 - DNA, 73 bp, Homo sapiens
  source 1..73: mol_type = genomic DNA
cggctcgttggtctaggggtatgattctcgcttagggtgcgagaggtcccgggttcaaatcccggacgagccc

SEQ ID NO: 335 - DNA, 74 bp, Homo sapiens
  source 1..74: mol_type = genomic DNA
agcccggctagctcagtcggtagagcatgagactcttaatctcagggtcgtgggttcgagccccacgttgggcg

SEQ ID NO: 336 - DNA, 92 bp, Homo sapiens
  source 1..92: mol_type = genomic DNA
tccttcgatagctcagttggtagagcggaggactgtagttggctgtgtccttagacatccttaggtcgctggttcgaatccggctcgaagga

SEQ ID NO: 337 - DNA, 74 bp, Homo sapiens
  source 1..74: mol_type = genomic DNA
ggggaattagctcaaatggtagagcgctcgcttagcatgcgagaggtagcgggatcgatgcccgcattctccag

SEQ ID NO: 338 - DNA, 74 bp, Homo sapiens
  source 1..74: mol_type = genomic DNA
cgccctcttagcgcagcgggcagcgcgtcagtctcataatctgaaggtcctgagttcgagcctcagagagggca

SEQ ID NO: 339 - DNA, 95 bp, Homo sapiens
  source 1..95: mol_type = genomic DNA
tgctccagtggcgcaatcggttagcgcgcggtacttatatggcagtatgtgtgcgagtgatgccgaggttgtgagttcgagcctcacctggagca

SEQ ID NO: 340 - DNA, 73 bp, Homo sapiens
  source 1..73: mol_type = genomic DNA
tgccgtgatcgtatagtggttagtactctgcgttgtggccgcagcaacctcggttcgaatccgagtcacggca

SEQ ID NO: 341 - DNA, 75 bp, Homo sapiens
  source 1..75: mol_type = genomic DNA
ggccggttagctcagttggttagagcgtggtgctaataacgccaaggtcgcgggttcgatccccgtacgggccac

SEQ ID NO: 342 - DNA, 74 bp, Homo sapiens
  source 1..74: mol_type = genomic DNA
agtttccgtagtgtagtggttatcacgtttgcctaacacgcgaaaggtccccggttcgaaaccgggcagaaaca

SEQ ID NO: 343 - DNA, 74 bp, Homo sapiens
  source 1..74: mol_type = genomic DNA
gcttctgtagtgtagtggttatcacgttcgcctcacacgcgaaaggtccccggttcgaaaccgggcagaagcaa

SEQ ID NO: 344 - DNA, 73 bp, Homo sapiens
  source 1..73: mol_type = genomic DNA
ttcctcgttagtatagtggtgagtatccccgcctgtcacgcgggagaccggggttcgattccccgacggggag

SEQ ID NO: 345 - DNA, 83 bp, Homo sapiens
  source 1..83: mol_type = genomic DNA
gtagtcgtggccgagtggttaaggcgatggacttgaaatccattggggtttccccgcgcaggttcgaatcctgtcggctacgg

SEQ ID NO: 346 - DNA, 73 bp, Homo sapiens
  source 1..73: mol_type = genomic DNA
aggttccatggtgtaatggttagcactctggactctgaatccagcgatccgagttcaaatctcggtggaacct

SEQ ID NO: 347 - DNA, 73 bp, Homo sapiens
  source 1..73: mol_type = genomic DNA
tcctcgttagtatagtggtgagtgtccccgtctgtcacgcgggagaccggggttcgattccccgacggggaga

SEQ ID NO: 348 - DNA, 74 bp, Homo sapiens
  source 1..74: mol_type = genomic DNA
gtttccgtagtgtagtggttatcacgttcgcctaacacgcgaaaggtccctggatcaaaaccaggcggaaacaa

SEQ ID NO: 349 - DNA, 75 bp, Homo sapiens
  source 1..75: mol_type = genomic DNA
cggccggttagctcagttggttagagcgtggtgctaataacgccaaggtcgcgggttcgatccccgtactggcca

SEQ ID NO: 350 - DNA, 73 bp, Homo sapiens
  source 1..73: mol_type = genomic DNA
ggccccatggtgtaatggtcagcactctggactctgaatccagcgatccgagttcaaatctcggtgggaccca

SEQ ID NO: 351 - DNA, 73 bp, Homo sapiens
  source 1..73: mol_type = genomic DNA
ggccccatggtgtaatggttagcactctggactttgaatccagcgatccgagttcaaatctcggtgggacctt

SEQ ID NO: 352 - DNA, 73 bp, Homo sapiens
  source 1..73: mol_type = genomic DNA
tgggggtgtagctcagtggtagagcgcgtgcttagcatgtacgaggtcccgggttcaatccccggcacctcca

SEQ ID NO: 353 - DNA, 73 bp, Homo sapiens
  source 1..73: mol_type = genomic DNA
ggggatgtagctcagtggtagagcgcatgcttagcatgcatgaggtcccgggttcgatccccagcatctccag

SEQ ID NO: 354 - DNA, 73 bp, Homo sapiens
  source 1..73: mol_type = genomic DNA
agggggtgtagctcagtggtagagcgcgtgcttcgcatgtacgaggccccgggttcgacccccggctcctcca

SEQ ID NO: 355 - DNA, 73 bp, Homo sapiens
  source 1..73: mol_type = genomic DNA
gggggtgtagctcagtggtagagcgcgtgcttagcatgcacgaggccccgggttcaatccccggcacctccat

SEQ ID NO: 356 - DNA, 73 bp, Homo sapiens
  source 1..73: mol_type = genomic DNA
gggggtgtagctcagtggtagagcgcgtgcttagcatgcacgaggccccgggttcaatccccggcacctccag

SEQ ID NO: 357 - DNA, 107 bp, Homo sapiens
  source 1..107: mol_type = genomic DNA
gtcaggatggccgagtggtctaaggcgccagactcaagctaagcttcctccgcggtggggattctggtctccaatggaggcgtgggttcgaatcccacttctgacac

SEQ ID NO: 358 - DNA, 106 bp, Homo sapiens
  source 1..106: mol_type = genomic DNA
tgtcaggatggccgagtggtctaaggcgccagactcaagcttggcttcctcgtgttgaggattctggtctccaatggaggcgtgggttcgaatcccacttctgaca

SEQ ID NO: 359 - DNA, 73 bp, Homo sapiens
  source 1..73: mol_type = genomic DNA
ggttccatggtgtaatggttagcactctggactctgaatccagcgatccgagttcaaatctcggtggaacctt

SEQ ID NO: 360 - DNA, 83 bp, Homo sapiens
  source 1..83: mol_type = genomic DNA
ggtagcgtggccgagcggtctaaggcgctggattaaggctccagtctcttcgggggcgtgggttcgaatcccaccgctgccag

SEQ ID NO: 361 - DNA, 74 bp, Homo sapiens
  source 1..74: mol_type = genomic DNA
tgcctccttagcgcagtaggcagcgcgtcagtctcataatctgaaggtcctgagttcgaacctcagagggggca

SEQ ID NO: 362 - DNA, 74 bp, Homo sapiens
  source 1..74: mol_type = genomic DNA
agcccggatagctcagtcggtagagcatcagacttttaatctgagggtccagggttcaagtccctgttcgggcg

SEQ ID NO: 363 - DNA, 74 bp, Homo sapiens
  source 1..74: mol_type = genomic DNA
gcctccttagcgcagtaggcagcgcgtcagtctcataatctgaaggtcctgagttcgaacctcagagggggcag

SEQ ID NO: 364 - DNA, 73 bp, Homo sapiens
  source 1..73: mol_type = genomic DNA
ttccctggtggtctagtggttaggattcggcgctctcaccgccgcggcccgggttcgattcccggtcagggaa

SEQ ID NO: 365 - DNA, 84 bp, Homo sapiens
  source 1..84: mol_type = genomic DNA
caccaggatggccgagtggttaaggcgttggacttaagatccaatggacatatgtccgcgtgggttcgaaccccactcctggta

SEQ ID NO: 366 - DNA, 73 bp, Homo sapiens
  source 1..73: mol_type = genomic DNA
tggctcgttggtctaggggtatgattctcgcttagggtgcgagaggtcccgggttcaaatcccggacgagccc

SEQ ID NO: 367 - DNA, 74 bp, Homo sapiens
  source 1..74: mol_type = genomic DNA
agccccagtggcctaatggataaggcattggcctcctaagccagggattgtgggttcgagtcccatctggggtg

SEQ ID NO: 368 - DNA, 73 bp, Homo sapiens
  source 1..73: mol_type = genomic DNA
ggggatatagctcaggggtagagcatttgactgcagatcaagaggtccccggttcaaatccgggtgccccccc

SEQ ID NO: 369 - DNA, 94 bp, Homo sapiens
  source 1..94: mol_type = genomic DNA
cccttcgatagctcagctggtagagcggaggactgtagctacttcctcagcaggagacatccttaggtcgctggttcgattccggctcgaagga

SEQ ID NO: 370 - DNA, 90 bp, Homo sapiens
  source 1..90: mol_type = genomic DNA
cccttcgatagctcagctggtagagcggaggactgtaggcgcgcgcccgtggccatccttaggtcgctggttcgattccggctcgaagga

SEQ ID NO: 371 - DNA, 74 bp, Homo sapiens
  source 1..74: mol_type = genomic DNA
tgggggattagctcaaatggtagagcgctcgcttagcatgcgagaggtagcgggatcgatgcccgcatcctcca

SEQ ID NO: 372 - DNA, 83 bp, Homo sapiens
  source 1..83: mol_type = genomic DNA
gtagtcgtggccgagtggttaaggcgatggactagaaatccattggggtctccccgcgcaggttcgaatcctgccgactacgg

SEQ ID NO: 373 - DNA, 74 bp, Homo sapiens
  source 1..74: mol_type = genomic DNA
gcctcgttagcgcagtaggtagcgcgtcagtctcataatctgaaggtcgtgagttcgatcctcacacggggcac

SEQ ID NO: 374 - DNA, 92 bp, Homo sapiens
  source 1..92: mol_type = genomic DNA
ggctctgtggcgcaatggatagcgcattggacttctagctgagcctagtgtggtcattcaaaggttgtgggttcgagtcccaccagagtcga

SEQ ID NO: 375 - DNA, 75 bp, Homo sapiens
  source 1..75: mol_type = genomic DNA
gtctctgtggcgcaatcggttagcgcgttcggctgttaaccgaaaggttggtggttcgagcccacccagggacgc

SEQ ID NO: 376 - DNA, 83 bp, Homo sapiens
  source 1..83: mol_type = genomic DNA
ggcagcgatggccgagtggttaaggcgttggacttgaaatccaatggggtctccccgcgcaggttcgaaccctgctcgctgcg

SEQ ID NO: 377 - DNA, 74 bp, Homo sapiens
  source 1..74: mol_type = genomic DNA
ggttccatagtgtagtggttatcacgtctgctttacacgcagaaggtcctgggttcgagccccagtggaaccat

SEQ ID NO: 378 - DNA, 74 bp, Homo sapiens
  source 1..74: mol_type = genomic DNA
ggttccatagtgtagcggttatcacgtctgctttacacgcagaaggtcctgggttcgagccccagtggaaccac

SEQ ID NO: 379 - DNA, 87 bp, Homo sapiens
  source 1..87: mol_type = genomic DNA
tggctctgtggcgcaatggatagcgcattggacttctagatagttagagaaattcaaaggttgtgggttcgagtcccaccagagtcg

SEQ ID NO: 380 - DNA, 84 bp, Homo sapiens
  source 1..84: mol_type = genomic DNA
taccagaatggccgagtggttaaggcgttggacttaagatccaatggattcatatccgcgtgggttcgaaccccacttctggta

SEQ ID NO: 381 - DNA, 74 bp, Homo sapiens
  source 1..74: mol_type = genomic DNA
ggcccggatagctcagtcggtagagcatcagacttttaatctgagggtccggggttcaagtccctgttcgggcg

SEQ ID NO: 382 - DNA, 74 bp, Homo sapiens
  source 1..74: mol_type = genomic DNA
gccgaaatagctcagttgggagagcgttagactgaagatctaaaggtccctggttcgatcccgggtttcggcag

SEQ ID NO: 383 - DNA, 74 bp, Homo sapiens
  source 1..74: mol_type = genomic DNA
gcccggatagctcagtcggtagagcatcagacttttaatctgagggtccagggttcaagtccctgttcgggcgg

SEQ ID NO: 384 - DNA, 74 bp, Homo sapiens
  source 1..74: mol_type = genomic DNA
gccgaaatagctcagttgggagagcgttagactgaagatctaaaggtccctggttcaatcccgggtttcggcag

SEQ ID NO: 385 - DNA, 83 bp, Homo sapiens
  source 1..83: mol_type = genomic DNA
ggacgaggtggccgagtggttaaggcgatggactgctaatccattgtgctttgcacgcgtgggttcgaatcccatcctcgtcg

SEQ ID NO: 386 - DNA, 73 bp, Homo sapiens
  source 1..73: mol_type = genomic DNA
ggctcgttggtctaggggtatgattctcggtttgggtccgagaggtcccgggttcaaatcccggacgagcccc

SEQ ID NO: 387 - DNA, 83 bp, Homo sapiens
  source 1..83: mol_type = genomic DNA
agtcacggtggccgagtggttaaggcgttggactcgaaatccaatggggtttccccgcacaggttcgaatcctgttcgtgacg

SEQ ID NO: 388 - DNA, 73 bp, Homo sapiens
  source 1..73: mol_type = genomic DNA
ctcctcgttagtatagtggttagtatccccgcctgtcacgcgggagaccggggttcaattccccgacggggag

SEQ ID NO: 389 - DNA, 73 bp, Homo sapiens
  source 1..73: mol_type = genomic DNA
ggacctcgtggcgcaacggtagcgcgtctgactccagatcagaaggctgcgtgttcgaatcacgtcggggtca

SEQ ID NO: 390 - DNA, 73 bp, Homo sapiens
  source 1..73: mol_type = genomic DNA
ggggatgtagctcagtggtagagcgcatgctttgcatgtatgaggccccgggttcgatccccggcatctccat

SEQ ID NO: 391 - DNA, 74 bp, Homo sapiens
  source 1..74: mol_type = genomic DNA
gccgaaatagctcagttgggagagcgttagactgaagatctaaaggtccctggttcgatcccgggtttcggcac

SEQ ID NO: 392 - DNA, 73 bp, Homo sapiens
  source 1..73: mol_type = genomic DNA
aggggatgtagctcagtggtagagcgcatgctttgcacgtatgaggccccgggttcaatccccggcatctcca

SEQ ID NO: 393 - DNA, 75 bp, Homo sapiens
  source 1..75: mol_type = genomic DNA
gtctctgtggcgcaatcggttagcgcgttcggctgttaaccgaaaggttggtggttcgagcccacccagggacgg

SEQ ID NO: 394 - DNA, 73 bp, Homo sapiens
  source 1..73: mol_type = genomic DNA
tcccacatggtctagcggttaggattcctggttttcacccaggcggcccgggttcgactcccggtgtgggaac

SEQ ID NO: 395 - DNA, 74 bp, Homo sapiens
  source 1..74: mol_type = genomic DNA
ggctccatagctcaggggttagagcgctggtcttgtaaaccaggggtcgcgagttcaattctcgctggggcctg

SEQ ID NO: 396 - DNA, 83 bp, Homo sapiens
  source 1..83: mol_type = genomic DNA
tggtagtgtggccgagcggtctaaggcgctggatttaggctccagtctcttcgggggcgtgggttcgaatcccaccactgcca

SEQ ID NO: 397 - DNA, 74 bp, Homo sapiens
  source 1..74: mol_type = genomic DNA
ggctccatagctcaggggttagagcactggtcttgtaaaccaggggtcgcgagttcaaatctcgctggggcctc

SEQ ID NO: 398 - DNA, 73 bp, Homo sapiens
  source 1..73: mol_type = genomic DNA
tggctcgttggtctagtggtatgattctcgctttgggtgcgagaggtcccgggttcaaatcccggacgagccc

SEQ ID NO: 399 - DNA, 95 bp, Homo sapiens
  source 1..95: mol_type = genomic DNA
ccttcgatagctcagctggtagagcggaggactgtagattgtacagacatttgcggacatccttaggtcgctggttcgattccggctcgaaggaa

SEQ ID NO: 400 - DNA, 74 bp, Homo sapiens
  source 1..74: mol_type = genomic DNA
aggccctatagctcaggggttagagcactggtcttgtaaaccaggggtcgcgagttcaaatctcgctggggcct

SEQ ID NO: 401 - DNA, 90 bp, Homo sapiens
  source 1..90: mol_type = genomic DNA
tccttcgatagctcagctggtagagcggaggactgtagtacttaatgtgtggtcatccttaggtcgctggttcgattccggctcgaagga

SEQ ID NO: 402 - DNA, 73 bp, Homo sapiens
  source 1..73: mol_type = genomic DNA
tggctcgttggtctaggggtatgattctcgctttgggtgcgagaggtcccgggttcaaatcccggacgagccc

SEQ ID NO: 403 - DNA, 74 bp, Homo sapiens
  source 1..74: mol_type = genomic DNA
gcccggctagctcagtcggtagagcatgggactcttaatcccagggtcgtgggttcgagccccacgttgggcgc

SEQ ID NO: 404 - DNA, 75 bp, Homo sapiens
  source 1..75: mol_type = genomic DNA
cggccggttagctcagttggttagagcgtggtgctaataacgccaaggtcgcgggttcgatccccgtacgggcca

SEQ ID NO: 405 - DNA, 73 bp, Homo sapiens
  source 1..73: mol_type = genomic DNA
tcccacatggtctagcggttaggattcctggttttcacccaggcggcccgggttcgactcccggtgtgggaat

SEQ ID NO: 406 - DNA, 83 bp, Homo sapiens
  source 1..83: mol_type = genomic DNA
gacgaggtggccgagtggttaaggcgatggactgctaatccattgtgctctgcacgcgtgggttcgaatcccatcctcgtcga

SEQ ID NO: 407 - DNA, 73 bp, Homo sapiens
  source 1..73: mol_type = genomic DNA
gccgtgatcgtatagtggttagtactctgcgttgtggccgcagcaacctcggttcgaatccgagtcacggcat

SEQ ID NO: 408 - DNA, 73 bp, Homo sapiens
  source 1..73: mol_type = genomic DNA
cgccgtgatcgtatagtggttagtactctgcgttgtggccgcagcaacctcggttcgaatccgagtcacggca

SEQ ID NO: 409 - DNA, 73 bp, Homo sapiens
  source 1..73: mol_type = genomic DNA
ggttccatggtgtaatggttagcactctggactctgaatccagcgatccgagttcaaatctcggtggaacctg

SEQ ID NO: 410 - DNA, 74 bp, Homo sapiens
  source 1..74: mol_type = genomic DNA
tgcccggctagctcagtcggtagagcatgggactcttaatcccagggtcgtgggttcgagccccacgttgggcg

SEQ ID NO: 411 - DNA, 74 bp, Homo sapiens
  source 1..74: mol_type = genomic DNA
gggccgcgtggcctaatggataaggcgtctgacttcggatcagaagattgcaggttcgagtcctgccgcggtcg

SEQ ID NO: 412 - DNA, 72 bp, Homo sapiens
  source 1..72: mol_type = genomic DNA
gcgccgctggtgtagtggtatcatgcaagattcccattcttgcgacccgggttcgattcccgggcggcgcac

SEQ ID NO: 413 - DNA, 74 bp, Homo sapiens
  source 1..74: mol_type = genomic DNA
gggccgcgtggcctaatggataaggcgtctgattccggatcagaagattgagggttcgagtcccttcgtggtcg

SEQ ID NO: 414 - DNA, 74 bp, Homo sapiens
  source 1..74: mol_type = genomic DNA
cgccccggtggcctaatggataaggcattggcctcctaagccagggattgtgggttcgagtcccacccggggta

SEQ ID NO: 415 - DNA, 74 bp, Homo sapiens
  source 1..74: mol_type = genomic DNA
gcccggctagctcagtcggtagagcatgagacccttaatctcagggtcgtgggttcgagccccacgttgggcgt

SEQ ID NO: 416 - DNA, 73 bp, Homo sapiens
  source 1..73: mol_type = genomic DNA
aggcgcggtggccaagtggtaaggcgtcggtctcgtaaaccgaagatcacgggttcgaaccccgtccgtgcct

SEQ ID NO: 417 - DNA, 83 bp, Homo sapiens
  source 1..83: mol_type = genomic DNA
ggtagcgtggccgagtggtctaaggcgctggatttaggctccagtcatttcgatggcgtgggttcgaatcccaccgctgccac

SEQ ID NO: 418 - DNA, 83 bp, Homo sapiens
  source 1..83: mol_type = genomic DNA
gggtagcgtggccgagcggtctaaggcgctggattaaggctccagtctcttcgggggcgtgggttcgaatcccaccgctgcca

SEQ ID NO: 419 - DNA, 84 bp, Homo sapiens
  source 1..84: mol_type = genomic DNA
agtcaggatggccgagcggtctaaggcgctgcgttcaggtcgcagtctcccctggaggcgtgggttcgaatcccacttctgaca

SEQ ID NO: 420 - DNA, 84 bp, Homo sapiens
  source 1..84: mol_type = genomic DNA
gtcaggatggccgagcggtctaaggcgctgcgttcaggtcgcagtctcccctggaggcgtgggttcgaatcccacttctgacag

SEQ ID NO: 421 - DNA, 74 bp, Homo sapiens
  source 1..74: mol_type = genomic DNA
gcctcgttagcgcagtaggcagcgcgtcagtctcataatctgaaggtcgtgagttcgagcctcacacggggcag

SEQ ID NO: 422 - DNA, 83 bp, Homo sapiens
  source 1..83: mol_type = genomic DNA
ggtagcgtggccgagcggtctaaggcgctggatttaggctccagtctcttcggaggcgtgggttcgaatcccaccgctgccag

SEQ ID NO: 423 - DNA, 89 bp, Homo sapiens
  source 1..89: mol_type = genomic DNA
tggctctgtggcgcaatggatagcgcattggacttctagtgacgaatagagcaattcaaaggttgtgggttcgaatcccaccagagtcg

SEQ ID NO: 424 - DNA, 72 bp, Homo sapiens
  source 1..72: mol_type = genomic DNA
cgcattggtggttcagtggtagaattctcgcctgccacgcgggaggcccgggttcgattcccggccaatgca

SEQ ID NO: 425 - DNA, 83 bp, Homo sapiens
  source 1..83: mol_type = genomic DNA
gctgtgatggccgagtggttaaggcgttggactcgaaatccaatggggtctccccgcgcaggttcgaatcctgctcacagcgt

SEQ ID NO: 426 - DNA, 75 bp, Homo sapiens
  source 1..75: mol_type = genomic DNA
ggcgccgtggcttagctggttaaagcgcctgtctagtaaacaggagatcctgggttcgaatcccagcggtgcctg

SEQ ID NO: 427 - DNA, 73 bp, Homo sapiens
  source 1..73: mol_type = genomic DNA
cgacctcgtggcgcaacggtagcgcgtctgactccagatcagaaggttgcgtgttcaaatcacgtcggggtca

SEQ ID NO: 428 - DNA, 83 bp, Homo sapiens
  source 1..83: mol_type = genomic DNA
agacgaggtggccgagtggttaaggcgatggactgctaatccattgtgctctgcacgcgtgggttcgaatcccatcctcgtcg

SEQ ID NO: 429 - DNA, 75 bp, Homo sapiens
  source 1..75: mol_type = genomic DNA
cggcgccgtggcttagttggttaaagcgcctgtctagtaaacaggagatcctgggttcgaatcccagcggtgcct

SEQ ID NO: 430 - DNA, 73 bp, Homo sapiens
  source 1..73: mol_type = genomic DNA
ggcctcgtggcgcaacggtagcgcgtctgactccagatcagaaggttgcgtgttcaaatcacgtcggggtcaa

SEQ ID NO: 431 - DNA, 73 bp, Homo sapiens
  source 1..73: mol_type = genomic DNA
agcgttggtggtatagtggtaagcatagctgccttccaagcagttgacccgggttcgattcccggccaacgca

SEQ ID NO: 432 - DNA, 73 bp, Homo sapiens
  source 1..73: mol_type = genomic DNA
tcctcgttagtatagtggtgagtatccccgcctgtcacgcgggagaccggggttcgattccccgacggggaga

SEQ ID NO: 433 - DNA, 73 bp, Homo sapiens
  source 1..73: mol_type = genomic DNA
ggctcgttggtctaggggtatgattctcgcttcgggtgcgagaggtcccgggttcaaatcccggacgagccct

SEQ ID NO: 434 - DNA, 75 bp, Homo sapiens
  source 1..75: mol_type = genomic DNA
ggcgccgtggcttagttggttaaagcgcctgtctagtaaacaggagatcctgggttcgaatcccagcggtgcctt

SEQ ID NO: 435 - DNA, 83 bp, Homo sapiens
  source 1..83: mol_type = genomic DNA
gtagtcgtggccgagtggttaaggcgatggactagaaatccattggggtctccccgcgcaggttcgaatcctgccgactacgt

SEQ ID NO: 436 - DNA, 73 bp, Homo sapiens
  source 1..73: mol_type = genomic DNA
tgacctcgtggcgcaatggtagcgcgtctgactccagatcagaaggttgcgtgttcaagtcacgtcggggtca

SEQ ID NO: 437 - DNA, 73 bp, Homo sapiens
  source 1..73: mol_type = genomic DNA
aggcgcggtggccaagtggtaaggcgtcggtctcgtaaaccgaagatcgcgggttcgaaccccgtccgtgcct

SEQ ID NO: 438 - DNA, 73 bp, Homo sapiens
  source 1..73: mol_type = genomic DNA
agggggtatagctcagtggtagagcatttgactgcagatcaagaggtccccggttcaaatccgggtgccccct

SEQ ID NO: 439 - DNA, 73 bp, Homo sapiens
  source 1..73: mol_type = genomic DNA
gggggtatagctcagtggtagagcatttgactgcagatcaagaggtccctggttcaaatccgggtgccccctc

SEQ ID NO: 440 - DNA, 73 bp, Homo sapiens
  source 1..73: mol_type = genomic DNA
gggggtatagctcagtggtagagcatttgactgcagatcaagaggtccccggttcaaatccgggtgccccctc

SEQ ID NO: 441 - DNA, 73 bp, Homo sapiens
  source 1..73: mol_type = genomic DNA
aggtcccatggtgtaatggttagcactctggactttgaatccagcgatccgagttcaaatctcggtgggacct

SEQ ID NO: 442 - DNA, 74 bp, Homo sapiens
  source 1..74: mol_type = genomic DNA
gacccagtggcctaatggataaggcatcagcctccggagctggggattgtgggttcgagtcccatctgggtcgc

SEQ ID NO: 443 - DNA, 74 bp, Homo sapiens
  source 1..74: mol_type = genomic DNA
agccccagtggcctaatggataaggcactggcctcctaagccagggattgtgggttcgagtcccacctggggta

SEQ ID NO: 444 - DNA, 74 bp, Homo sapiens
  source 1..74: mol_type = genomic DNA
gccccagtggcctaatggataaggcactggcctcctaagccagggattgtgggttcgagtcccacctggggtgt

SEQ ID NO: 445 - DNA, 74 bp, Homo sapiens
  source 1..74: mol_type = genomic DNA
agaccgcgtggcctaatggataaggcgtctgacttcggatcagaagattgagggttcgagtcccttcgtggtcg

SEQ ID NO: 446 - DNA, 75 bp, Homo sapiens
  source 1..75: mol_type = genomic DNA
cgtctctgtggcgcaatcggttagcgcgttcggctgttaaccgaaaggttggtggttcgagcccacccagggacg

SEQ ID NO: 447 - DNA, 73 bp, Homo sapiens
  source 1..73: mol_type = genomic DNA
ggcgttggtggtatagtggttagcatagctgccttccaagcagttgacccgggttcgattcccggccaacgca

SEQ ID NO: 448 - DNA, 74 bp, Homo sapiens
  source 1..74: mol_type = genomic DNA
gtttccgtagtgtagcggttatcacattcgcctcacacgcgaaaggtccccggttcgatcccgggcggaaacag

SEQ ID NO: 449 - DNA, 75 bp, Homo sapiens
  source 1..75: mol_type = genomic DNA
tggcgccgtggcttagttggttaaagcgcctgtctagtaaacaggagatcctgggttcgaatcccagcggtgcct

SEQ ID NO: 450 - DNA, 94 bp, Homo sapiens
  source 1..94: mol_type = genomic DNA
gctccagtggcgcaatcggttagcgcgcggtacttatatgacagtgcgagcggagcaatgccgaggttgtgagttcgatcctcacctggagcac

SEQ ID NO: 451 - DNA, 72 bp, Homo sapiens
  source 1..72: mol_type = genomic DNA
gcatgggtggttcagtggtagaattctcgcctgccacgcgggaggcccgggttcgattcccggcccatgcag

SEQ ID NO: 452 - DNA, 18 bp, synthetic construct
  misc_feature 1..18: note = Description of Sequence: Synthetic oligonucleotide
  source 1..18: mol_type = other DNA
aaaatataaatatatttc

SEQ ID NO: 453-454 - skipped (2 entries)

SEQ ID NO: 455 - DNA, 15 bp, synthetic construct
  misc_feature 1..15: note = Description of Sequence: Synthetic oligonucleotide
  source 1..15: mol_type = other DNA
aattcttcggaatgt

SEQ ID NO: 456-460 - skipped (5 entries)

SEQ ID NO: 461 - DNA, 20 bp, synthetic construct
  misc_feature 1..20: note = Description of Sequence: Synthetic oligonucleotide
  source 1..20: mol_type = other DNA
caggcgggttctgcccgcgc

SEQ ID NO: 462 - DNA, 18 bp, synthetic construct
  misc_feature 1..18: note = Description of Sequence: Synthetic oligonucleotide
  source 1..18: mol_type = other DNA
catacctgcaagggtatc

SEQ ID NO: 463 - DNA, 15 bp, synthetic construct
  misc_feature 1..15: note = Description of Sequence: Synthetic oligonucleotide
  source 1..15: mol_type = other DNA
cgaccgcaaggttgt

SEQ ID NO: 464 - DNA, 15 bp, synthetic construct
  misc_feature 1..15: note = Description of Sequence: Synthetic oligonucleotide
  source 1..15: mol_type = other DNA
cgaccttgcggtcat

SEQ ID NO: 465 - DNA, 18 bp, synthetic construct
  misc_feature 1..18: note = Description of Sequence: Synthetic oligonucleotide
  source 1..18: mol_type = other DNA
cgatgctaatcacatcgt

SEQ ID NO: 466 - DNA, 15 bp, synthetic construct
  misc_feature 1..15: note = Description of Sequence: Synthetic oligonucleotide
  source 1..15: mol_type = other DNA
cgatggtgacatcat

SEQ ID NO: 467 - DNA, 16 bp, synthetic construct
  misc_feature 1..16: note = Description of Sequence: Synthetic oligonucleotide
  source 1..16: mol_type = other DNA
cgatggtttacatcgt

SEQ ID NO: 468 - DNA, 13 bp, synthetic construct
  misc_feature 1..13: note = Description of Sequence: Synthetic oligonucleotide
  source 1..13: mol_type = other DNA
cgccgtaaggtgt

SEQ ID NO: 469 - DNA, 12 bp, synthetic construct
  misc_feature 1..12: note = Description of Sequence: Synthetic oligonucleotide
  source 1..12: mol_type = other DNA
cgccttaggtgt

SEQ ID NO: 470 - DNA, 15 bp, synthetic construct
  misc_feature 1..15: note = Description of Sequence: Synthetic oligonucleotide
  source 1..15: mol_type = other DNA
cgcctttcgacgcgt

SEQ ID NO: 471 - DNA, 13 bp, synthetic construct
  misc_feature 1..13: note = Description of Sequence: Synthetic oligonucleotide
  source 1..13: mol_type = other DNA
cgcttcacggcgt

SEQ ID NO: 472 - DNA, 15 bp, synthetic construct
  misc_feature 1..15: note = Description of Sequence: Synthetic oligonucleotide
  source 1..15: mol_type = other DNA
cggcagcaatgctgt

SEQ ID NO: 473 - DNA, 13 bp, synthetic construct
  misc_feature 1..13: note = Description of Sequence: Synthetic oligonucleotide
  source 1..13: mol_type = other DNA
cggctccgccttc

SEQ ID NO: 474 - DNA, 16 bp, synthetic construct
  misc_feature 1..16: note = Description of Sequence: Synthetic oligonucleotide
  source 1..16: mol_type = other DNA
cgggtatcacagggtc

SEQ ID NO: 475 - DNA, 17 bp, synthetic construct
  misc_feature 1..17: note = Description of Sequence: Synthetic oligonucleotide
  source 1..17: mol_type = other DNA
cggtgcgcaagcgctgt

SEQ ID NO: 476 - DNA, 18 bp, synthetic construct
  misc_feature 1..18: note = Description of Sequence: Synthetic oligonucleotide
  source 1..18: mol_type = other DNA
cgtacgggtgaccgtacc

SEQ ID NO: 477 - DNA, 13 bp, synthetic construct
  misc_feature 1..13: note = Description of Sequence: Synthetic oligonucleotide
  source 1..13: mol_type = other DNA
cgtcaaagacttc

SEQ ID NO: 478 - DNA, 13 bp, synthetic construct
  misc_feature 1..13: note = Description of Sequence: Synthetic oligonucleotide
  source 1..13: mol_type = other DNA
cgtcgtaagactt

SEQ ID NO: 479 - DNA, 14 bp, synthetic construct
  misc_feature 1..14: note = Description of Sequence: Synthetic oligonucleotide
  source 1..14: mol_type = other DNA
cgttgaataaacgt

SEQ ID NO: 480-485 - skipped (6 entries)

SEQ ID NO: 486 - DNA, 19 bp, synthetic construct
  misc_feature 1..19: note = Description of Sequence: Synthetic oligonucleotide
  source 1..19: mol_type = other DNA
taactagatactttcagat

SEQ ID NO: 487 - DNA, 15 bp, synthetic construct
  misc_feature 1..15: note = Description of Sequence: Synthetic oligonucleotide
  source 1..15: mol_type = other DNA
tactcgtatgggtgc

SEQ ID NO: 488 - DNA, 13 bp, synthetic construct
  misc_feature 1..13: note = Description of Sequence: Synthetic oligonucleotide
  source 1..13: mol_type = other DNA
tactttgcggtgt

SEQ ID NO: 489 - DNA, 19 bp, synthetic construct
  misc_feature 1..19: note = Description of Sequence: Synthetic oligonucleotide
  source 1..19: mol_type = other DNA
taggcgagtaacatcgtgc

SEQ ID NO: 490 - DNA, 19 bp, synthetic construct
  misc_feature 1..19: note = Description of Sequence: Synthetic oligonucleotide
  source 1..19: mol_type = other DNA
taggcgtgaatagcgcctc

SEQ ID NO: 491 - DNA, 19 bp, synthetic construct
  misc_feature 1..19: note = Description of Sequence: Synthetic oligonucleotide
  source 1..19: mol_type = other DNA
taggtcgcgagagcggcgc

SEQ ID NO: 492 - DNA, 19 bp, synthetic construct
  misc_feature 1..19: note = Description of Sequence: Synthetic oligonucleotide
  source 1..19: mol_type = other DNA
taggtcgcgtaagcggcgc

SEQ ID NO: 493 - DNA, 17 bp, synthetic construct
  misc_feature 1..17: note = Description of Sequence: Synthetic oligonucleotide
  source 1..17: mol_type = other DNA
taggtggttatccacgc

SEQ ID NO: 494-495 - skipped (2 entries)

SEQ ID NO: 496 - DNA, 18 bp, synthetic construct
  misc_feature 1..18: note = Description of Sequence: Synthetic oligonucleotide
  source 1..18: mol_type = other DNA
tatacgtgaaagcgtatc

SEQ ID NO: 497 - DNA, 21 bp, synthetic construct
  misc_feature 1..21: note = Description of Sequence: Synthetic oligonucleotide
  source 1..21: mol_type = other DNA
tatagggtcaaaaactctatc

SEQ ID NO: 498 - DNA, 20 bp, synthetic construct
  misc_feature 1..20: note = Description of Sequence: Synthetic oligonucleotide
  source 1..20: mol_type = other DNA
tatgcagaaatacctgcatc

SEQ ID NO: 499 - DNA, 15 bp, synthetic construct
  misc_feature 1..15: note = Description of Sequence: Synthetic oligonucleotide
  source 1..15: mol_type = other DNA
tccccatacgggggc

SEQ ID NO: 500 - DNA, 14 bp, synthetic construct
  misc_feature 1..14: note = Description of Sequence: Synthetic oligonucleotide
  source 1..14: mol_type = other DNA
tcccgaaggggttc

SEQ ID NO: 501 - DNA, 15 bp, synthetic construct
  misc_feature 1..15: note = Description of Sequence: Synthetic oligonucleotide
  source 1..15: mol_type = other DNA
tctacgtatgtgggc

SEQ ID NO: 502 - DNA, 14 bp, synthetic construct
  misc_feature 1..14: note = Description of Sequence: Synthetic oligonucleotide
  source 1..14: mol_type = other DNA
tctcataggagttc

SEQ ID NO: 503 - DNA, 14 bp, synthetic construct
  misc_feature 1..14: note = Description of Sequence: Synthetic oligonucleotide
  source 1..14: mol_type = other DNA
tctcctctggaggc

SEQ ID NO: 504 - DNA, 15 bp, synthetic construct
  misc_feature 1..15: note = Description of Sequence: Synthetic oligonucleotide
  source 1..15: mol_type = other DNA
tcttagcaataaggt

SEQ ID NO: 505 - DNA, 14 bp, synthetic construct
  misc_feature 1..14: note = Description of Sequence: Synthetic oligonucleotide
  source 1..14: mol_type = other DNA
tcttgtaggagttc

SEQ ID NO: 506 - DNA, 15 bp, synthetic construct
  misc_feature 1..15: note = Description of Sequence: Synthetic oligonucleotide
  source 1..15: mol_type = other DNA
tgaacgtaagttcgc

SEQ ID NO: 507 - DNA, 16 bp, synthetic construct
  misc_feature 1..16: note = Description of Sequence: Synthetic oligonucleotide
  source 1..16: mol_type = other DNA
tgaactgcgaggttcc

SEQ ID NO: 508 - skipped

SEQ ID NO: 509 - DNA, 15 bp, synthetic construct
  misc_feature 1..15: note = Description of Sequence: Synthetic oligonucleotide
  source 1..15: mol_type = other DNA
tgaccgaaaggtcgt

SEQ ID NO: 510 - DNA, 15 bp, synthetic construct
  misc_feature 1..15: note = Description of Sequence: Synthetic oligonucleotide
  source 1..15: mol_type = other DNA
tgaccgcaaggtcgt

SEQ ID NO: 511 - DNA, 14 bp, synthetic construct
  misc_feature 1..14: note = Description of Sequence: Synthetic oligonucleotide
  source 1..14: mol_type = other DNA
tgagctctgctctc

SEQ ID NO: 512 - DNA, 18 bp, synthetic construct
  misc_feature 1..18: note = Description of Sequence: Synthetic oligonucleotide
  source 1..18: mol_type = other DNA
tgaggcctcacggcctac

SEQ ID NO: 513 - DNA, 15 bp, synthetic construct
  misc_feature 1..15: note = Description of Sequence: Synthetic oligonucleotide
  source 1..15: mol_type = other DNA
tgagggcaacttcgt

SEQ ID NO: 514 - DNA, 16 bp, synthetic construct
  misc_feature 1..16: note = Description of Sequence: Synthetic oligonucleotide
  source 1..16: mol_type = other DNA
tgagggtcatacctcc

SEQ ID NO: 515 - DNA, 18 bp, synthetic construct
  misc_feature 1..18: note = Description of Sequence: Synthetic oligonucleotide
  source 1..18: mol_type = other DNA
tgagggtgcaaatcctcc

SEQ ID NO: 516 - DNA, 13 bp, synthetic construct
  misc_feature 1..13: note = Description of Sequence: Synthetic oligonucleotide
  source 1..13: mol_type = other DNA
tgccgaaaggcgt

SEQ ID NO: 517 - DNA, 13 bp, synthetic construct
  misc_feature 1..13: note = Description of Sequence: Synthetic oligonucleotide
  source 1..13: mol_type = other DNA
tgccgtaaggcgt

SEQ ID NO: 518 - DNA, 14 bp, synthetic construct
  misc_feature 1..14: note = Description of Sequence: Synthetic oligonucleotide
  source 1..14: mol_type = other DNA
tgcggtctccgcgc

SEQ ID NO: 519 - DNA, 11 bp, synthetic construct
  misc_feature 1..11: note = Description of Sequence: Synthetic oligonucleotide
  source 1..11: mol_type = other DNA
tgctagagcat

SEQ ID NO: 520 - DNA, 16 bp, synthetic construct
  misc_feature 1..16: note = Description of Sequence: Synthetic oligonucleotide
  source 1..16: mol_type = other DNA
tgctcgtatagagctc

SEQ ID NO: 521 - DNA, 15 bp, synthetic construct
  misc_feature 1..15: note = Description of Sequence: Synthetic oligonucleotide
  source 1..15: mol_type = other DNA
tggacaattgtctgc

SEQ ID NO: 522 - DNA, 15 bp, synthetic construct
  misc_feature 1..15: note = Description of Sequence: Synthetic oligonucleotide
  source 1..15: mol_type = other DNA
tggacagatgtccgt

SEQ ID NO: 523 - DNA, 15 bp, synthetic construct
  misc_feature 1..15: note = Description of Sequence: Synthetic oligonucleotide
  source 1..15: mol_type = other DNA
tggacaggtgtccgc

SEQ ID NO: 524 - DNA, 15 bp, synthetic construct
  misc_feature 1..15: note = Description of Sequence: Synthetic oligonucleotide
  source 1..15: mol_type = other DNA
tggacggttgtccgc

SEQ ID NO: 525 - DNA, 13 bp, synthetic construct
  misc_feature 1..13: note = Description of Sequence: Synthetic oligonucleotide
  source 1..13: mol_type = other DNA
tggacttgtggtc

SEQ ID NO: 526 - DNA, 16 bp, synthetic construct
  misc_feature 1..16: note = Description of Sequence: Synthetic oligonucleotide
  source 1..16: mol_type = other DNA
tggagattctctccgc

SEQ ID NO: 527 - DNA, 14 bp, synthetic construct
  misc_feature 1..14: note = Description of Sequence: Synthetic oligonucleotide
  source 1..14: mol_type = other DNA
tggcataggcctgc

SEQ ID NO: 528 - DNA, 14 bp, synthetic construct
  misc_feature 1..14: note = Description of Sequence: Synthetic oligonucleotide
  source 1..14: mol_type = other DNA
tggcttatgtctac

SEQ ID NO: 529 - DNA, 16 bp, synthetic construct
  misc_feature 1..16: note = Description of Sequence: Synthetic oligonucleotide
  source 1..16: mol_type = other DNA
tgggagttaatcccgt

SEQ ID NO: 530 - DNA, 14 bp, synthetic construct
  misc_feature 1..14: note = Description of Sequence: Synthetic oligonucleotide
  source 1..14: mol_type = other DNA
tgggatcttcccgc

SEQ ID NO: 531 - DNA, 16 bp, synthetic construct
  misc_feature 1..16: note = Description of Sequence: Synthetic oligonucleotide
  source 1..16: mol_type = other DNA
tgggcagaaatgtctc

SEQ ID NO: 532 - DNA, 15 bp, synthetic construct
  misc_feature 1..15: note = Description of Sequence: Synthetic oligonucleotide
  source 1..15: mol_type = other DNA
tgggcgttcgcccgc

SEQ ID NO: 533 - DNA, 14 bp, synthetic construct
  misc_feature 1..14: note = Description of Sequence: Synthetic oligonucleotide
  source 1..14: mol_type = other DNA
tgggcttcgcccgc

SEQ ID NO: 534 - DNA, 16 bp, synthetic construct
  misc_feature 1..16: note = Description of Sequence: Synthetic oligonucleotide
  source 1..16: mol_type = other DNA
tgggggataaccccgt

SEQ ID NO: 535 - DNA, 15 bp, synthetic construct
  misc_feature 1..15: note = Description of Sequence: Synthetic oligonucleotide
  source 1..15: mol_type = other DNA
tgggggtttccccgt

SEQ ID NO: 536 - skipped

SEQ ID NO: 537 - DNA, 15 bp, synthetic construct
  misc_feature 1..15: note = Description of Sequence: Synthetic oligonucleotide
  source 1..15: mol_type = other DNA
tggtggcaacaccgt

SEQ ID NO: 538 - DNA, 14 bp, synthetic construct
  misc_feature 1..14: note = Description of Sequence: Synthetic oligonucleotide
  source 1..14: mol_type = other DNA
tggtttatagccgt

SEQ ID NO: 539 - DNA, 19 bp, synthetic construct
  misc_feature 1..19: note = Description of Sequence: Synthetic oligonucleotide
  source 1..19: mol_type = other DNA
tgtacggtaataccgtacc

SEQ ID NO: 540 - DNA, 15 bp, synthetic construct
  misc_feature 1..15: note = Description of Sequence: Synthetic oligonucleotide
  source 1..15: mol_type = other DNA
tgtccgcaaggacgt

SEQ ID NO: 541 - DNA, 15 bp, synthetic construct
  misc_feature 1..15: note = Description of Sequence: Synthetic oligonucleotide
  source 1..15: mol_type = other DNA
tgtcctaacggacgt

SEQ ID NO: 542 - DNA, 18 bp, synthetic construct
  misc_feature 1..18: note = Description of Sequence: Synthetic oligonucleotide
  source 1..18: mol_type = other DNA
tgtcctattaacggacgt

SEQ ID NO: 543 - DNA, 16 bp, synthetic construct
  misc_feature 1..16: note = Description of Sequence: Synthetic oligonucleotide
  source 1..16: mol_type = other DNA
tgtccttcacgggcgt

SEQ ID NO: 544 - DNA, 13 bp, synthetic construct
  misc_feature 1..13: note = Description of Sequence: Synthetic oligonucleotide
  source 1..13: mol_type = other DNA
tgtcttaggacgt

SEQ ID NO: 545 - DNA, 18 bp, synthetic construct
  misc_feature 1..18: note = Description of Sequence: Synthetic oligonucleotide
  source 1..18: mol_type = other DNA
tgtgcgttaacgcgtacc

SEQ ID NO: 546 - DNA, 16 bp, synthetic construct
  misc_feature 1..16: note = Description of Sequence: Synthetic oligonucleotide
  source 1..16: mol_type = other DNA
tgtgtcgcaaggcacc

SEQ ID NO: 547 - DNA, 15 bp, synthetic construct
  misc_feature 1..15: note = Description of Sequence: Synthetic oligonucleotide
  source 1..15: mol_type = other DNA
tgttcgtaaggactt

SEQ ID NO: 548 - DNA, 16 bp, synthetic construct
  misc_feature 1..16: note = Description of Sequence: Synthetic oligonucleotide
  source 1..16: mol_type = other DNA
ttcacagaaatgtgtc

SEQ ID NO: 549 - DNA, 14 bp, synthetic construct
  misc_feature 1..14: note = Description of Sequence: Synthetic oligonucleotide
  source 1..14: mol_type = other DNA
ttccctcgtggagt

SEQ ID NO: 550 - DNA, 14 bp, synthetic construct
  misc_feature 1..14: note = Description of Sequence: Synthetic oligonucleotide
  source 1..14: mol_type = other DNA
ttccctctgggagc

SEQ ID NO: 551 - DNA, 14 bp, synthetic construct
  misc_feature 1..14: note = Description of Sequence: Synthetic oligonucleotide
  source 1..14: mol_type = other DNA
ttcccttgtggatc

SEQ ID NO: 552 - DNA, 13 bp, synthetic construct
  misc_feature 1..13: note = Description of Sequence: Synthetic oligonucleotide
  source 1..13: mol_type = other DNA
ttccttcgggagc

SEQ ID NO: 553 - DNA, 15 bp, synthetic construct
  misc_feature 1..15: note = Description of Sequence: Synthetic oligonucleotide
  source 1..15: mol_type = other DNA
ttctagcaatagagt

SEQ ID NO: 554 - DNA, 16 bp, synthetic construct
  misc_feature 1..16: note = Description of Sequence: Synthetic oligonucleotide
  source 1..16: mol_type = other DNA
ttctccactggggagc

SEQ ID NO: 555 - DNA, 15 bp, synthetic construct
  misc_feature 1..15: note = Description of Sequence: Synthetic oligonucleotide
  source 1..15: mol_type = other DNA
ttctcgagagggagc

SEQ ID NO: 556 - DNA, 15 bp, synthetic construct
  misc_feature 1..15: note = Description of Sequence: Synthetic oligonucleotide
  source 1..15: mol_type = other DNA
ttctcgtatgagagc

SEQ ID NO: 557 - DNA, 19 bp, synthetic construct
  misc_feature 1..19: note = Description of Sequence: Synthetic oligonucleotide
  source 1..19: mol_type = other DNA
tttaaggttttcccttaac

SEQ ID NO: 558 - DNA, 14 bp, synthetic construct
  misc_feature 1..14: note = Description of Sequence: Synthetic oligonucleotide
  source 1..14: mol_type = other DNA
tttcattgtggagt

SEQ ID NO: 559 - DNA, 14 bp, synthetic construct
  misc_feature 1..14: note = Description of Sequence: Synthetic oligonucleotide
  source 1..14: mol_type = other DNA
tttcgaaggaatcc

SEQ ID NO: 560 - DNA, 13 bp, synthetic construct
  misc_feature 1..13: note = Description of Sequence: Synthetic oligonucleotide
  source 1..13: mol_type = other DNA
tttcttcggaagc

SEQ ID NO: 561 - DNA, 16 bp, synthetic construct
  misc_feature 1..16: note = Description of Sequence: Synthetic oligonucleotide
  source 1..16: mol_type = other DNA
tttggggcaactcaac

SEQ ID NO: 562 - RNA, 342 nt, synthetic construct
  misc_feature 1..342: note = Description of Sequence: Synthetic polynucleotide
  variation 5..6: note = a, c, u, or g
  variation 15..16: note = a, c, u, or g
  variation 21: note = a, c, u, or g
  variation 30..32: note = a, c, u, or g
  variation 34: note = a, c, u, or g
  variation 37: note = a, c, u, or g
  variation 41..45: note = a, c, u, or g
  misc_feature 47..317: note = This region may encompass 1-271 nucleotides
  variation 47..320: note = a, c, u, or g
  variation 328..329: note = a, c, u, or g
  variation 333..334: note = a, c, u, or g
  variation 336..337: note = a, c, u, or g
  variation 1..342: note = May or may not be present
  misc_feature 1..342: note = See specification as filed for detailed description of substitutions and preferred embodiments
  source 1..342: mol_type = other RNA
rkssnndtrghbyannytgrndgwdvdydnnnbnhbnryrnnnnndnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrrdtyrannyybnnhnnbwccd

SEQ ID NO: 563 - RNA, 341 nt, synthetic construct
  misc_feature 1..341: note = Description of Sequence: Synthetic polynucleotide
  variation 16: note = a, c, u, or g
  variation 30: note = a, c, u, or g
  variation 46..316: note = a, c, u, or g
  misc_feature 46..316: note = This region may encompass 1-271 nucleotides
  variation 319: note = a, c, u, or g
  variation 328: note = a, c, u, or g
  variation 1..341: note = May or may not be present
  misc_feature 1..341: note = See specification as filed for detailed description of substitutions and preferred embodiments
  source 1..341: mol_type = other RNA
rksgrwdkrghbyavnyggtdgarvrydynhkywbhryrhdhdhrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbhnrgdtcrayncyydvhhyywccd

SEQ ID NO: 564 - RNA, 341 nt, synthetic construct
  misc_feature 1..341: note = Description of Sequence: Synthetic polynucleotide
  variation 16: note = a, c, u, or g
  variation 30: note = a, c, u, or g
  variation 46..316: note = a, c, u, or g
  misc_feature 46..316: note = This region may encompass 1-271 nucleotides
  variation 319: note = a, c, u, or g
  variation 1..341: note = May or may not be present
  misc_feature 1..341: note = See specification as filed for detailed description of substitutions and preferred embodiments
  source 1..341: mol_type = other RNA
ggggrwdtrghbyavnyggtdgarvrydynhkywkhryrhdhdhrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbhnrgdtcraybccydvhhyytcca

SEQ ID NO: 565 - RNA, 343 nt, synthetic construct
  misc_feature 1..343: note = Description of Sequence: Synthetic polynucleotide
  variation 2..8: note = a, c, u, or g
  variation 12..13: note = a, c, u, or g
  variation 17: note = a, c, u, or g
  variation 22..24: note = a, c, u, or g
  variation 26..27: note = a, c, u, or g
  variation 30..35: note = a, c, u, or g
  variation 38: note = a, c, u, or g
  variation 43: note = a, c, u, or g
  variation 45..322: note = a, c, u, or g
  misc_feature 48..318: note = This region may encompass 1-271 nucleotides
  variation 329: note = a, c, u, or g
  variation 333..342: note = a, c, u, or g
  variation 1..343: note = May or may not be present
  misc_feature 1..343: note = See specification as filed for detailed description of substitutions and preferred embodiments
  source 1..343: mol_type = other RNA
gnnnnnnnkvgnnhddnhwrrnnnrnnvynnnnnnbtnckrhnbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttyranyybnnnnnnnnnnd

SEQ ID NO: 566 - RNA, 342 nt, synthetic construct
  misc_feature 1..342: note = Description of Sequence: Synthetic polynucleotide
  variation 3: note = a, c, u, or g
  variation 6..7: note = a, c, u, or g
  variation 13: note = a, c, u, or g
  variation 26: note = a, c, u, or g
  variation 32: note = a, c, u, or g
  variation 37: note = a, c, u, or g
  variation 44: note = a, c, u, or g
  variation 47..317: note = a, c, u, or g
  misc_feature 47..317: note = This region may encompass 1-271 nucleotides
  variation 328: note = a, c, u, or g
  variation 336..338: note = a, c, u, or g
  variation 340: note = a, c, u, or g
  variation 1..342: note = May or may not be present
  misc_feature 1..342: note = See specification as filed for detailed description of substitutions and preferred embodiments
  source 1..342: mol_type = other RNA
grnvbnnvkbgbnydrwtrgwygarnrydyynsvytnckrmkbnrrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnshvggttyrantycbdbynnnbnhr

SEQ ID NO: 567 - RNA, 342 nt, synthetic construct
  misc_feature 1..342: note = Description of Sequence: Synthetic polynucleotide
  variation 3: note = a, c, u, or g
  variation 7: note = a, c, u, or g
  variation 47..317: note = a, c, u, or g
  misc_feature 47..317: note = This region may encompass 1-271 nucleotides
  variation 336: note = a, c, u, or g
  variation 340: note = a, c, u, or g
  variation 1..342: note = May or may not be present
  misc_feature 1..342: note = See specification as filed for detailed description of substitutions and preferred embodiments
  source 1..342: mol_type = other RNA
grnvyvnskkgssydawtggaygarsgyryykgmythckrakymrrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnshrggttygavtycydbynbdbnyg

SEQ ID NO: 568 - RNA, 341 nt, synthetic construct
  misc_feature 1..341: note = Description of Sequence: Synthetic polynucleotide
  variation 2: note = a, c, u, or g
  variation 4..6: note = a, c, u, or g
  variation 12: note = a, c, u, or g
  variation 17: note = a, c, u, or g
  variation 25: note = a, c, u, or g
  variation 28..30: note = a, c, u, or g
  variation 43..316: note = a, c, u, or g
  misc_feature 46..316: note = This region may encompass 1-271 nucleotides
  variation 318..319: note = a, c, u, or g
  variation 327: note = a, c, u, or g
  variation 331..332: note = a, c, u, or g
  variation 334..337: note = a, c, u, or g
  variation 339..340: note = a, c, u, or g
  variation 1..341: note = May or may not be present
  misc_feature 1..341: note = See specification as filed for detailed description of substitutions and preferred embodiments
  source 1..341: mol_type = other RNA
dnynnndtrghnhvrynggbhtrdnrynnnbsryyrttwahbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnnrgtkhvwnhcynnbnnnndnnr

SEQ ID NO: 569 - RNA, 341 nt, synthetic construct
  misc_feature 1..341: note = Description of Sequence: Synthetic polynucleotide
  variation 17: note = a, c, u, or g
  variation 28: note = a, c, u, or g
  variation 46..316: note = a, c, u, or g
  misc_feature 46..316: note = This region may encompass 1-271 nucleotides
  variation 1..341: note = May or may not be present
  misc_feature 1..341: note = See specification as filed for detailed description of substitutions and preferred embodiments
  source 1..341: mol_type = other RNA
rtytcygtrghryvrtnggbytarhgcnttysryyrttwahbddannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrgtrgtkhvwdmcyayysvrrrrbr

SEQ ID NO: 570 - RNA, 341 nt, synthetic construct
  misc_feature 1..341: note = Description of Sequence: Synthetic polynucleotide
  variation 46..316: note = a, c, u, or g
  misc_feature 46..316: note = This region may encompass 1-271 nucleotides
  variation 1..341: note = May or may not be present
  misc_feature 1..341: note = See specification as filed for detailed description of substitutions and preferred embodiments
  source 1..341: mol_type = other RNA
rtytcygtrghryvrtbggbytaghgcbttysryyrttaahyddannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrgtrgtkhvwdmcyayysvrrrryg

SEQ ID NO: 571 - RNA, 342 nt, synthetic construct
  misc_feature 1..342: note = Description of Sequence: Synthetic polynucleotide
  variation 2..6: note = a, c, u, or g
  variation 12: note = a, c, u, or g
  variation 16: note = a, c, u, or g
  variation 22: note = a, c, u, or g
  variation 26: note = a, c, u, or g
  variation 29: note = a, c, u, or g
  variation 31..32: note = a, c, u, or g
  variation 44: note = a, c, u, or g
  misc_feature 47..317: note = This region may encompass 1-271 nucleotides
  variation 47..319: note = a, c, u, or g
  variation 328: note = a, c, u, or g
  variation 333..334: note = a, c, u, or g
  variation 336..339: note = a, c, u, or g
  variation 1..342: note = May or may not be present
  misc_feature 1..342: note = See specification as filed for detailed description of substitutions and preferred embodiments
  source 1..342: mol_type = other RNA
knnnnndyrrynhrrnyygrhntmdnrynbnnvhytrtcrhdbnbvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnsrgytbrhnyyysnnhnnnnbmr

SEQ ID NO: 572 - RNA, 339 nt, synthetic construct
  misc_feature 1..339: note = Description of Sequence: Synthetic polynucleotide
  variation 2: note = a, c, u, or g
  variation 6: note = a, c, u, or g
  variation 44..314: note = a, c, u, or g
  misc_feature 44..314: note = This region may encompass 1-271 nucleotides
  variation 333: note = a, c, u, or g
  variation 1..339: note = May or may not be present
  misc_feature 1..339: note = See specification as filed for detailed description of substitutions and preferred embodiments
  source 1..339: mol_type = other RNA
knsbbnwyarywyrgtggtkmgwrtbysyryytrtcaygbrsrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnykgrgytbrhkyycchrwnvvksmr

SEQ ID NO: 573 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
tmctyrtyagtatrgtggtkmgtrtyycygyctgtcaygyggrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyggrgttyrmkyyccyrasrrggag

SEQ ID NO: 574 - RNA, 342 nt, synthetic construct
  misc_feature 1..342: note = Description of Sequence: Synthetic polynucleotide
  variation 3..6: note = a, c, u, or g
  variation 12..13: note = a, c, u, or g
  variation 16: note = a, c, u, or g
  variation 24: note = a, c, u, or g
  variation 26: note = a, c, u, or g
  variation 29..32: note = a, c, u, or g
  variation 34: note = a, c, u, or g
  variation 42: note = a, c, u, or g
  variation 44..319: note = a, c, u, or g
  misc_feature 47..317: note = This region may encompass 1-271 nucleotides
  variation 328: note = a, c, u, or g
  variation 333..334: note = a, c, u, or g
  variation 336..340: note = a, c, u, or g
  variation 1..342: note = May or may not be present
  misc_feature 1..342: note = See specification as filed for detailed description of substitutions and preferred embodiments
  source 1..342: mol_type = other RNA
gsnnnndtrvynnavnkcgdbyynrnvbnnnnvnyyrcarmnbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbdrttcranyyyvnnhnnnnnyy

SEQ ID NO: 575 - RNA, 340 nt, synthetic construct
  misc_feature 1..340: note = Description of Sequence: Synthetic polynucleotide
  variation 16: note = a, c, u, or g
  variation 45..315: note = a, c, u, or g
  misc_feature 45..315: note = This region may encompass 1-271 nucleotides
  variation 1..340: note = May or may not be present
  misc_feature 1..340: note = See specification as filed for detailed description of substitutions and preferred embodiments
  source 1..340: mol_type = other RNA
gsgsryrkrgytbasnkgdktaravyahttgrcyrcaratcmarnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyyydrttcrartyyvgktryychyy

SEQ ID NO: 576 - RNA, 340 nt, synthetic construct
  misc_feature 1..340: note = Description of Sequence: Synthetic polynucleotide
  variation 16: note = a, c, u, or g
  variation 45..315: note = a, c, u, or g
  misc_feature 45..315: note = This region may encompass 1-271 nucleotides
  variation 1..340: note = May or may not be present
  misc_feature 1..340: note = See specification as filed for detailed description of substitutions and preferred embodiments
  source 1..340: mol_type = other RNA
gggsryrkrgytyasntgrktagagcayttgactgcaratcmarnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyyyrrttcraatyyvgktrcycmyy

SEQ ID NO: 577 - RNA, 341 nt, synthetic construct
  misc_feature 1..341: note = Description of Sequence: Synthetic polynucleotide
  variation 2: note = a, c, u, or g
  variation 4..6: note = a, c, u, or g
  variation 12..13: note = a, c, u, or g
  variation 16: note = a, c, u, or g
  variation 20..21: note = a, c, u, or g
  variation 24: note = a, c, u, or g
  variation 28..31: note = a, c, u, or g
  variation 33: note = a, c, u, or g
  variation 40..41: note = a, c, u, or g
  variation 43..319: note = a, c, u, or g
  misc_feature 46..316: note = This region may encompass 1-271 nucleotides
  variation 327: note = a, c, u, or g
  variation 331..332: note = a, c, u, or g
  variation 335..339: note = a, c, u, or g
  variation 1..341: note = May or may not be present
  misc_feature 1..341: note = See specification as filed for detailed description of substitutions and preferred embodiments
  source 1..341: mol_type = other RNA
dnbnnndtvgbnnarnhggnnhanvvynnnnvnytbtkrnnhnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrrttyvanybynnbhnnnnnhd

SEQ ID NO: 578 - RNA, 340 nt, synthetic construct
  misc_feature 1..340: note = Description of Sequence: Synthetic polynucleotide
  variation 4..5: note = a, c, u, or g
  variation 12: note = a, c, u, or g
  variation 21: note = a, c, u, or g
  variation 27..28: note = a, c, u, or g
  misc_feature 45..315: note = This region may encompass 1-271 nucleotides
  variation 45..317: note = a, c, u, or g
  variation 331: note = a, c, u, or g
  variation 335..336: note = a, c, u, or g
  variation 1..340: note = May or may not be present
  misc_feature 1..340: note = See specification as filed for detailed description of substitutions and preferred embodiments
  source 1..340: mol_type = other RNA
kdbnnydtggynbarkmggdnavvrynnhbvrytbtkrrbhvdvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndrrttyvadybyhnbhdnnvhmd

SEQ ID NO: 579 - RNA, 340 nt, synthetic construct
  misc_feature 1..340: note = Description of Sequence: Synthetic polynucleotide
  variation 4: note = a, c, u, or g
  variation 21: note = a, c, u, or g
  variation 27..28: note = a, c, u, or g
  misc_feature 45..315: note = This region may encompass 1-271 nucleotides
  variation 45..317: note = a, c, u, or g
  variation 331: note = a, c, u, or g
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
kdbnvydtggydbartmggknavvrynnwsrrytbtkrabhsdvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndrrttyvadysyhnbhdbnvhmk

SEQ ID NO: 580 - RNA, 342 nt, synthetic construct
  misc_feature 1..342: note = Description of Sequence: Synthetic polynucleotide
  variation 1..2: note = a, c, u, or g
  variation 5..6: note = a, c, u, or g
  variation 9: note = a, c, u, or g
  variation 12: note = a, c, u, or g
  variation 16: note = a, c, u, or g
  variation 20..21: note = a, c, u, or g
  variation 26..27: note = a, c, u, or g
  variation 29..33: note = a, c, u, or g
  variation 41: note = a, c, u, or g
  variation 44..318: note = a, c, u, or g
  misc_feature 47..317: note = This region may encompass 1-271 nucleotides
  variation 320..321: note = a, c, u, or g
  variation 328: note = a, c, u, or g
  variation 333..336: note = a, c, u, or g
  variation 340..341: note = a, c, u, or g
  variation 1..342: note = May or may not be present
  misc_feature 1..342: note = See specification as filed for detailed description of substitutions and preferred embodiments
  source 1..342: mol_type = other RNA
nnbbnndtnrwnhrdnhygnnbhrdnnynnnnnvytytsrnbvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbnnrytbrwnyyhbnnnndvvnnd

SEQ ID NO: 581 - RNA, 340 nt, synthetic construct
  misc_feature 1..340: note = Description of Sequence: Synthetic polynucleotide
  variation 1..2: note = a, c, u, or g
  variation 5: note = a, c, u, or g
  variation 12: note = a, c, u, or g
  variation 20: note = a, c, u, or g
  variation 29: note = a, c, u, or g
  variation 31: note = a, c, u, or g
  variation 39: note = a, c, u, or g
  variation 43: note = a, c, u, or g
  misc_feature 45..315: note = This region may encompass 1-271 nucleotides
  variation 45..316: note = a, c, u, or g
  variation 319: note = a, c, u, or g
  variation 326: note = a, c, u, or g
  variation 334: note = a, c, u, or g
  variation 338: note = a, c, u, or g
  variation 1..340: note = May or may not be present
  misc_feature 1..340: note = See specification as filed for detailed description of substitutions and preferred embodiments
  source 1..340: mol_type = other RNA
nnbynbdyrgtntrdyagbnkrrvvywbnbnvytytsanbvhndnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnydnrytbrwnychbrkbndvvnvd

SEQ ID NO: 582 - RNA, 339 nt, synthetic construct
  misc_feature 1..339: note = Description of Sequence: Synthetic polynucleotide
  variation 1: note = a, c, u, or g
  variation 28: note = a, c, u, or g
  variation 30: note = a, c, u, or g
  variation 42: note = a, c, u, or g
  variation 44..314: note = a, c, u, or g
  misc_feature 44..314: note = This region may encompass 1-271 nucleotides
  variation 318: note = a, c, u, or g
  variation 333: note = a, c, u, or g
  variation 1..339: note = May or may not be present
  misc_feature 1..339: note = See specification as filed for detailed description of substitutions and preferred embodiments
  source 1..339: mol_type = other RNA
ncsydbrtggtstakygshkrrsaywbnknsytytcahbvmndnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbyrnrytyrwytcyyrgbnwrsraw

SEQ ID NO: 583 - RNA, 342 nt, synthetic construct
  misc_feature 1..342: note = Description of Sequence: Synthetic polynucleotide
  variation 4..7: note = a, c, u, or g
  variation 12: note = a, c, u, or g
  variation 16: note = a, c, u, or g
  variation 21..22: note = a, c, u, or g
  variation 26: note = a, c, u, or g
  variation 29..34: note = a, c, u, or g
  variation 41..319: note = a, c, u, or g
  misc_feature 47..317: note = This region may encompass 1-271 nucleotides
  variation 328: note = a, c, u, or g
  variation 333..338: note = a, c, u, or g
  variation 1..342: note = May or may not be present
  misc_feature 1..342: note = See specification as filed for detailed description of substitutions and preferred embodiments
  source 1..342: mol_type = other RNA
rbvnnnntvrynyrrnytbdnntadnrynnnnnnyybccvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvvstbbrwnhcbbnnnnnnbbyw

SEQ ID NO: 584 - RNA, 340 nt, synthetic construct
  misc_feature 1..340: note = Description of Sequence: Synthetic polynucleotide
  variation 5: note = a, c, u, or g
  variation 28: note = a, c, u, or g
  variation 39..40: note = a, c, u, or g
  variation 42: note = a, c, u, or g
  variation 45..315: note = a, c, u, or g
  misc_feature 45..315: note = This region may encompass 1-271 nucleotides
  variation 317: note = a, c, u, or g
  variation 335: note = a, c, u, or g
  variation 1..340: note = May or may not be present
  misc_feature 1..340: note = See specification as filed for detailed description of substitutions and preferred embodiments
  source 1..340: mol_type = other RNA
gbvbnsvtrrtdyrrdcggkdadmatdnhhrhytbccannynkdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbnrgsttbrwttccyksbsnvygca

SEQ ID NO: 585 - RNA, 340 nt, synthetic construct
  misc_feature 1..340: note = Description of Sequence: Synthetic polynucleotide
  variation 5: note = a, c, u, or g
  variation 28: note = a, c, u, or g
  variation 39: note = a, c, u, or g
  variation 42: note = a, c, u, or g
  variation 45..315: note = a, c, u, or g
  misc_feature 45..315: note = This region may encompass 1-271 nucleotides
  variation 335: note = a, c, u, or g
  variation 1..340: note = May or may not be present
  misc_feature 1..340: note = See specification as filed for detailed description of substitutions and preferred embodiments
  source 1..340: mol_type = other RNA
gyvynsvtrrtdyrrwcggkkadmatdnhhrhytbccandynkdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbvrgsttyrwttccyksbsnvygca

SEQ ID NO: 586 - RNA, 342 nt, synthetic construct
  misc_feature 1..342: note = Description of Sequence: Synthetic polynucleotide
  variation 4..7: note = a, c, u, or g
  variation 13: note = a, c, u, or g
  variation 25..26: note = a, c, u, or g
  variation 29..31: note = a, c, u, or g
  variation 34: note = a, c, u, or g
  variation 42: note = a, c, u, or g
  variation 45..317: note = a, c, u, or g
  misc_feature 47..317: note = This region may encompass 1-271 nucleotides
  variation 319..320: note = a, c, u, or g
  variation 328: note = a, c, u, or g
  variation 332..333: note = a, c, u, or g
  variation 336..338: note = a, c, u, or g
  variation 1..342: note = May or may not be present
  misc_feature 1..342: note = See specification as filed for detailed description of substitutions and preferred embodiments
  source 1..342: mol_type = other RNA
kgynnnndtvgbnhagbytgghyannvynnndbnytgtgrhnvhnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnnrgytcranycynnbhnnnvrym

SEQ ID NO: 587 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
gchrtgaybgtayagkggttasyactctgygytgtggccrcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncwyggytcraatcygagtcaygrca

SEQ ID NO: 588 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
gcmrtgayygtatagtggttagyactctgygytgtggccrcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncwyggttcraatcygagtcaygrca

SEQ ID NO: 589 - RNA, 342 nt, synthetic construct
  misc_feature 1..342: note = Description of Sequence: Synthetic polynucleotide
  variation 1: note = a, c, u, or g
  variation 4..5: note = a, c, u, or g
  variation 7: note = a, c, u, or g
  variation 17: note = a, c, u, or g
  variation 31..32: note = a, c, u, or g
  variation 34: note = a, c, u, or g
  variation 37: note = a, c, u, or g
  variation 42..320: note = a, c, u, or g
  misc_feature 47..317: note = This region may encompass 1-271 nucleotides
  variation 328..329: note = a, c, u, or g
  variation 332..334: note = a, c, u, or g
  variation 336..339: note = a, c, u, or g
  variation 1..342: note = May or may not be present
  misc_feature 1..342: note = See specification as filed for detailed description of substitutions and preferred embodiments
  source 1..342: mol_type = other RNA
nvsnnbndtrgybyrrnywggbhrdvrydbnnbnytnatrannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndsywydannchnnnhnnnnsba

SEQ ID NO: 590 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 326..327: note = a, c, u, or g
  variation 335: note = a, c, u, or g
  variation 1..340: note = May or may not be present
  misc_feature 1..340: note = See specification as filed for detailed description of substitutions and preferred embodiments
  source 1..340: mol_type = other RNA
gsyybrktrgykyrrtyggyhagmgcrygktrctdataayryyrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnryrrsywydanncycrymyngrsca

SEQ ID NO: 591 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 1..340: note = May or may not be present
  misc_feature 1..340: note = See specification as filed for detailed description of substitutions and preferred embodiments
  source 1..340: mol_type = other RNA
gsyysrktrgykcartyggyhagmgcgyggtrctdataayrcyrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngygrgytcrabhcycrymybgrsca

SEQ ID NO: 592 - RNA, 341 nt, synthetic construct
  misc_feature 1..341: note = Description of Sequence: Synthetic polynucleotide
  variation 1: note = a, c, u, or g
  variation 3..6: note = a, c, u, or g
  variation 11..12: note = a, c, u, or g
  variation 16..17: note = a, c, u, or g
  variation 21..22: note = a, c, u, or g
  variation 25..26: note = a, c, u, or g
  variation 28..31: note = a, c, u, or g
  variation 41: note = a, c, u, or g
  variation 43..316: note = a, c, u, or g
  misc_feature 46..316: note = This region may encompass 1-271 nucleotides
  variation 318..319: note = a, c, u, or g
  variation 327: note = a, c, u, or g
  variation 331..332: note = a, c, u, or g
  variation 335..338: note = a, c, u, or g
  variation 340: note = a, c, u, or g
  variation 1..341: note = May or may not be present
  misc_feature 1..341: note = See specification as filed for detailed description of substitutions and preferred embodiments
  source 1..341: mol_type = other RNA
nbnnnndtrsnnbarnnhggnnddnnbnnnnvdhycatahnbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnnrgdtsdanhmynnbhnnnnvnw

SEQ ID NO: 593 - RNA, 339 nt, synthetic construct
  misc_feature 1..339: note = Description of Sequence: Synthetic polynucleotide
  variation 4: note = a, c, u, or g
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
rbcnbvktrgygcagydgghagyryryyrgkyycataahyyvrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnsdkrgdtsdadmmymwsmbvbgsya

SEQ ID NO: 594 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
rschbvktrgygcagydgghagcryryyrgkyycataaycyrrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnswkrgwtsdadmcymwsmbvkgsya

SEQ ID NO: 595 - RNA, 342 nt, synthetic construct
  misc_feature 1..342: note = Description of Sequence: Synthetic polynucleotide
  variation 2..7: note = a, c, u, or g
  variation 9..12: note = a, c, u, or g
  variation 16: note = a, c, u, or g
  variation 23: note = a, c, u, or g
  variation 26: note = a, c, u, or g
  variation 28..34: note = a, c, u, or g
  variation 37: note = a, c, u, or g
  variation 41..317: note = a, c, u, or g
  misc_feature 47..317: note = This region may encompass 1-271 nucleotides
  variation 319..320: note = a, c, u, or g
  variation 328: note = a, c, u, or g
  variation 332..333: note = a, c, u, or g
  variation 335..340: note = a, c, u, or g
  variation 1..342: note = May or may not be present
  misc_feature 1..342: note = See specification as filed for detailed description of substitutions and preferred embodiments
  source 1..342: mol_type = other RNA
vnnnnnntnnnnvrrnhhgkhhndhnvnnnnnnnhynardnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnnvbythvanymbnnbnnnnnnbr

SEQ ID NO: 596 - RNA, 342 nt, synthetic construct
  misc_feature 1..342: note = Description of Sequence: Synthetic polynucleotide
  variation 6: note = a, c, u, or g
  variation 33: note = a, c, u, or g
  variation 41: note = a, c, u, or g
  variation 43: note = a, c, u, or g
  variation 46..317: note = a, c, u, or g
  misc_feature 47..317: note = This region may encompass 1-271 nucleotides
  variation 319: note = a, c, u, or g
  variation 328: note = a, c, u, or g
  variation 333: note = a, c, u, or g
  variation 336: note = a, c, u, or g
  variation 340: note = a, c, u, or g
  variation 1..342: note = May or may not be present
  misc_feature 1..342: note = See specification as filed for detailed description of substitutions and preferred embodiments
  source 1..342: mol_type = other RNA
rbbvvndtrkhhsrrbhygkhhtrwbrhdbhdnrythardnynhdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnvgbythvanymybnbbnbbvnya

SEQ ID NO: 597 - RNA, 342 nt, synthetic construct
  misc_feature 1..342: note = Description of Sequence: Synthetic polynucleotide
  variation 6: note = a, c, u, or g
  variation 33: note = a, c, u, or g
  variation 43: note = a, c, u, or g
  variation 46..317: note = a, c, u, or g
  misc_feature 47..317: note = This region may encompass 1-271 nucleotides
  variation 319: note = a, c, u, or g
  variation 333: note = a, c, u, or g
  variation 336: note = a, c, u, or g
  variation 340: note = a, c, u, or g
  variation 1..342: note = May or may not be present
  misc_feature 1..342: note = See specification as filed for detailed description of substitutions and preferred embodiments
  source 1..342: mol_type = other RNA
rbbvvndtrkhhsrrbhygkhhtrwkrhdbhdnrythardhynhdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnvgbythvavymybnbynbbvnya

SEQ ID NO: 598 - RNA, 342 nt, synthetic construct
  misc_feature 1..342: note = Description of Sequence: Synthetic polynucleotide
  variation 1..7: note = a, c, u, or g
  variation 11..12: note = a, c, u, or g
  variation 16: note = a, c, u, or g
  variation 21: note = a, c, u, or g
  variation 26: note = a, c, u, or g
  variation 30..32: note = a, c, u, or g
  variation 44..320: note = a, c, u, or g
  misc_feature 47..317: note = This region may encompass 1-271 nucleotides
  variation 328: note = a, c, u, or g
  variation 332..333: note = a, c, u, or g
  variation 335..340: note = a, c, u, or g
  variation 1..342: note = May or may not be present
  misc_feature 1..342: note = See specification as filed for detailed description of substitutions and preferred embodiments
  source 1..342: mol_type = other RNA
nnnnnnntrsnnharnhwrrnttdrnrydnnnsvyyyttmmbvnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvrytyrwnhybnnbnnnnnnhd

SEQ ID NO: 599 - RNA, 340 nt, synthetic construct
  misc_feature 1..340: note = Description of Sequence: Synthetic polynucleotide
  variation 1: note = a, c, u, or g
  variation 6: note = a, c, u, or g
  variation 11: note = a, c, u, or g
  variation 29: note = a, c, u, or g
  variation 43: note = a, c, u, or g
  misc_feature 45..315: note = This region may encompass 1-271 nucleotides
  variation 45..317: note = a, c, u, or g
  variation 331: note = a, c, u, or g
  variation 333..334: note = a, c, u, or g
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
nhvbdnvkrsnhharbhrrbtdrdrydbndgryyyttmmymhndnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrgrytyrwbyysynbnnhndrhr

SEQ ID NO: 600 - RNA, 340 nt, synthetic construct
  misc_feature 1..340: note = Description of Sequence: Synthetic polynucleotide
  misc_feature 45..315: note = This region may encompass 1-271 nucleotides
  variation 45..316: note = a, c, u, or g
  variation 333: note = a, c, u, or g
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
vhvbrdvkascwharthrrbtdrwrcrkvdgactyttmatchswnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndrgrytyrwkyysyhbnhynkryr

SEQ ID NO: 601 - RNA, 341 nt, synthetic construct
  misc_feature 1..341: note = Description of Sequence: Synthetic polynucleotide
  variation 4..6: note = a, c, u, or g
  variation 29..31: note = a, c, u, or g
  variation 33: note = a, c, u, or g
  variation 41: note = a, c, u, or g
  variation 43..318: note = a, c, u, or g
  misc_feature 46..316: note = This region may encompass 1-271 nucleotides
  variation 327: note = a, c, u, or g
  variation 331..332: note = a, c, u, or g
  variation 335..338: note = a, c, u, or g
  variation 1..341: note = May or may not be present
  misc_feature 1..341: note = See specification as filed for detailed description of substitutions and preferred embodiments
  source 1..341: mol_type = other RNA
kbbnnndtagyyyarhytggbwwgrryrnnnbnyygaarvnbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbdgttcranychnnbhnnnnvma

SEQ ID NO: 602 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 1..340: note = May or may not be present
  misc_feature 1..340: note = See specification as filed for detailed description of substitutions and preferred embodiments
  source 1..340: mol_type = other RNA
kbyvwrrtwgyyyarttggstagrrydykrbrcygaarrysyhmnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyckggttcrayycysggtywbrvma

SEQ ID NO: 603 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
gcyraratwgctcarttgggagagygttasacygaagatctwmnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnyctggttcrayycygggtttcrvca

SEQ ID NO: 604 - RNA, 342 nt, synthetic construct
  misc_feature 1..342: note = Description of Sequence: Synthetic polynucleotide
  variation 4..6: note = a, c, u, or g
  variation 16: note = a, c, u, or g
  variation 21: note = a, c, u, or g
  variation 29..34: note = a, c, u, or g
  variation 37: note = a, c, u, or g
  variation 41..320: note = a, c, u, or g
  misc_feature 47..317: note = This region may encompass 1-271 nucleotides
  variation 328: note = a, c, u, or g
  variation 331..334: note = a, c, u, or g
  variation 336..338: note = a, c, u, or g
  variation 1..342: note = May or may not be present
  misc_feature 1..342: note = See specification as filed for detailed description of substitutions and preferred embodiments
  source 1..342: mol_type = other RNA
sksnnndtvgbbyagnyygbnyyrdvvynnnnnnhtnggrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndgttcranycnnnnhnnnbmsm

SEQ ID NO: 605 - RNA, 338 nt, synthetic construct
  misc_feature 1..338: note = Description of Sequence: Synthetic polynucleotide
  variation 39: note = a, c, u, or g
  variation 43..313: note = a, c, u, or g
  misc_feature 43..313: note = This region may encompass 1-271 nucleotides
  variation 1..338: note = May or may not be present
  misc_feature 1..338: note = See specification as filed for detailed description of substitutions and preferred embodiments
  source 1..338: mol_type = other RNA
ggctsgttggkctagkgbtrtgrttctcrsythggrysnragnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncygggttcaaatcvyrgasgagccc

SEQ ID NO: 606 - RNA, 338 nt, synthetic construct
  misc_feature 1..338: note = Description of Sequence: Synthetic polynucleotide
  variation 43..313: note = a, c, u, or g
  misc_feature 43..313: note = This region may encompass 1-271 nucleotides
  variation 1..338: note = May or may not be present
  misc_feature 1..338: note = See specification as filed for detailed description of substitutions and preferred embodiments
  source 1..338: mol_type = other RNA
ggctcgttggtctagkggtrtgrttctcgstthggrysbgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggttcaaatcccggacgagccc

SEQ ID NO: 607 - RNA, 342 nt, synthetic construct
  misc_feature 1..342: note = Description of Sequence: Synthetic polynucleotide
  variation 2..7: note = a, c, u, or g
  variation 9..13: note = a, c, u, or g
  variation 16: note = a, c, u, or g
  variation 21: note = a, c, u, or g
  variation 25..28: note = a, c, u, or g
  variation 30..34: note = a, c, u, or g
  variation 37: note = a, c, u, or g
  variation 42..320: note = a, c, u, or g
  misc_feature 47..317: note = This region may encompass 1-271 nucleotides
  variation 332..340: note = a, c, u, or g
  variation 1..342: note = May or may not be present
  misc_feature 1..342: note = See specification as filed for detailed description of substitutions and preferred embodiments
  source 1..342: mol_type = other RNA
dnnnnnnynnnnnarnbhggnbbannnndnnnnnyynswrmnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnrkttyradycynnnnnnnnnbd

SEQ ID NO: 608 - RNA, 341 nt, synthetic construct
  misc_feature 1..341: note = Description of Sequence: Synthetic polynucleotide
  variation 2..5: note = a, c, u, or g
  variation 36: note = a, c, u, or g
  variation 46..316: note = a, c, u, or g
  misc_feature 46..316: note = This region may encompass 1-271 nucleotides
  variation 319: note = a, c, u, or g
  variation 331: note = a, c, u, or g
  variation 335..336: note = a, c, u, or g
  variation 338..339: note = a, c, u, or g
  variation 1..341: note = May or may not be present
  misc_feature 1..341: note = See specification as filed for detailed description of substitutions and preferred embodiments
  source 1..341: mol_type = other RNA
knnnnbdtrgchsarkbtggttavdghrdbkdrcynswraybmvdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvyngkttyradyccnrbhnnbnnyd

SEQ ID NO: 609 - RNA, 341 nt, synthetic construct
  misc_feature 1..341: note = Description of Sequence: Synthetic polynucleotide
  variation 2..3: note = a, c, u, or g
  variation 5: note = a, c, u, or g
  variation 36: note = a, c, u, or g
  variation 46..316: note = a, c, u, or g
  misc_feature 46..316: note = This region may encompass 1-271 nucleotides
  variation 335..336: note = a, c, u, or g
  variation 338..339: note = a, c, u, or g
  variation 1..341: note = May or may not be present
  misc_feature 1..341: note = See specification as filed for detailed description of substitutions and preferred embodiments
  source 1..341: mol_type = other RNA
knndnbrtrgchsarkctggttavdghrwykrrctnswrayymrdnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvydggttyraaycchrbynnynnyk

SEQ ID NO: 610 - RNA, 341 nt, synthetic construct
  misc_feature 1..341: note = Description of Sequence: Synthetic polynucleotide
  variation 4..7: note = a, c, u, or g
  variation 12: note = a, c, u, or g
  variation 16: note = a, c, u, or g
  variation 25: note = a, c, u, or g
  variation 29..31: note = a, c, u, or g
  variation 33: note = a, c, u, or g
  variation 36: note = a, c, u, or g
  variation 41: note = a, c, u, or g
  variation 43..319: note = a, c, u, or g
  misc_feature 46..316: note = This region may encompass 1-271 nucleotides
  variation 327: note = a, c, u, or g
  variation 331..337: note = a, c, u, or g
  variation 341: note = a, c, u, or g
  variation 1..341: note = May or may not be present
  misc_feature 1..341: note = See specification as filed for detailed description of substitutions and preferred embodiments
  source 1..341: mol_type = other RNA
rbbnnnntrgynhadnhykghyrdnryrnnnsnhyngtwansnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndgwyyvanbyhnnnnnnnrvyn

SEQ ID NO: 611 - RNA, 340 nt, synthetic construct
  misc_feature 1..340: note = Description of Sequence: Synthetic polynucleotide
  variation 4: note = a, c, u, or g
  variation 6: note = a, c, u, or g
  variation 12: note = a, c, u, or g
  variation 24: note = a, c, u, or g
  variation 45..315: note = a, c, u, or g
  misc_feature 45..315: note = This region may encompass 1-271 nucleotides
  variation 317: note = a, c, u, or g
  variation 326: note = a, c, u, or g
  variation 331..332: note = a, c, u, or g
  variation 334: note = a, c, u, or g
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
rbbnbndtvgynharbygghyrdnryryhbsbcyhgtwavsvdrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvndrgwtyvanbyyhnnbndnrvyb

SEQ ID NO: 612 - RNA, 340 nt, synthetic construct
  misc_feature 1..340: note = Description of Sequence: Synthetic polynucleotide
  variation 4: note = a, c, u, or g
  variation 6: note = a, c, u, or g
  variation 12: note = a, c, u, or g
  variation 24: note = a, c, u, or g
  variation 45..315: note = a, c, u, or g
  misc_feature 45..315: note = This region may encompass 1-271 nucleotides
  variation 326: note = a, c, u, or g
  variation 332: note = a, c, u, or g
  variation 334: note = a, c, u, or g
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
rsynbndtvgynharbtgghyrdnryryhksbcyhgtaavsmdrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvhdrgwtyvanbyyhdnbndnrsyt

SEQ ID NO: 613 - RNA, 342 nt, synthetic construct
  misc_feature 1..342: note = Description of Sequence: Synthetic polynucleotide
  variation 4..6: note = a, c, u, or g
  variation 29..32: note = a, c, u, or g
  variation 34: note = a, c, u, or g
  variation 42: note = a, c, u, or g
  variation 44..317: note = a, c, u, or g
  misc_feature 47..317: note = This region may encompass 1-271 nucleotides
  variation 319: note = a, c, u, or g
  variation 321: note = a, c, u, or g
  variation 328: note = a, c, u, or g
  variation 333: note = a, c, u, or g
  variation 336..338: note = a, c, u, or g
  variation 1..342: note = May or may not be present
  misc_feature 1..342: note = See specification as filed for detailed description of substitutions and preferred embodiments
  source 1..342: mol_type = other RNA
rvvnnndtrrybhhrhyhgghytadvvynnnnrnbtccavanbnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnrngttcranychynbhnnnbbhd

SEQ ID NO: 614 - RNA, 339 nt, synthetic construct
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA
grmmkvrkggysmarytggharssykkybrrstccasakbvrwnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnsygkgttcradycmcrkyksbgyma

SEQ ID NO: 615 - RNA, 339 nt, synthetic construct; identical to SEQ ID NO: 614
  misc_feature 1..339: note = Description of Sequence: Synthetic polynucleotide
  variation 44..314: note = a, c, u, or g
  misc_feature 44..314: note = This region may encompass 1-271 nucleotides
  variation 1..339: note = May or may not be present
  misc_feature 1..339: note = See specification as filed for detailed description of substitutions and preferred embodiments
  source 1..339: mol_type = other RNA

SEQ ID NO: 616 - RNA, 342 nt, synthetic construct
  misc_feature 1..342: note = Description of Sequence: Synthetic polynucleotide
  variation 3..6: note = a, c, u, or g
  variation 9..10: note = a, c, u, or g
  variation 12..13: note = a, c, u, or g
  variation 16: note = a, c, u, or g
  variation 25..26: note = a, c, u, or g
  variation 30..32: note = a, c, u, or g
  variation 42: note = a, c, u, or g
  variation 44..317: note = a, c, u, or g
  misc_feature 47..317: note = This region may encompass 1-271 nucleotides
  variation 319..320: note = a, c, u, or g
  variation 328: note = a, c, u, or g
  variation 332..333: note = a, c, u, or g
  variation 336..340: note = a, c, u, or g
  variation 1..342: note = May or may not be present
  misc_feature 1..342: note = See specification as filed for detailed description of substitutions and preferred embodiments
  source 1..342: mol_type = other RNA
bbnnnndtnnynnarnytgsyhwrnnrbdnnnrdctrtarvnynnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnvnnvgwtyrantcbnnbhnnnnnvd

SEQ ID NO: 617 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 336: note = a, c, u, or g
  variation 1..340: note = May or may not be present
  misc_feature 1..340: note = See specification as filed for detailed description of substitutions and preferred embodiments
  source 1..340: mol_type = other RNA
bbkkbdatagytcagbtgsytagagydkwkractrtagrkymwknnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnsctggwtyrahtcyrrstbsnmsvd

SEQ ID NO: 618 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 1..340: note = May or may not be present
  misc_feature 1..340: note = See specification as filed for detailed description of substitutions and preferred embodiments
  source 1..340: mol_type = other RNA
bbkksdatagytcagytggytagagcdkwkgactrtagrkymwknnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnsctggttyrawtccrrstysdmsva

SEQ ID NO: 619 - RNA, 341 nt, synthetic construct
  misc_feature 1..341: note = Description of Sequence: Synthetic polynucleotide
  variation 2: note = a, c, u, or g
  variation 4..7: note = a, c, u, or g
  variation 12: note = a, c, u, or g
  variation 15..16: note = a, c, u, or g
  variation 21: note = a, c, u, or g
  variation 24..25: note = a, c, u, or g
  variation 28: note = a, c, u, or g
  variation 30..33: note = a, c, u, or g
  variation 36: note = a, c, u, or g
  variation 40..319: note = a, c, u, or g
  misc_feature 46..316: note = This region may encompass 1-271 nucleotides
  variation 327: note = a, c, u, or g
  variation 330..339: note = a, c, u, or g
  variation 1..341: note = May or may not be present
  misc_feature 1..341: note = See specification as filed for detailed description of substitutions and preferred embodiments
  source 1..341: mol_type = other RNA
dndnnnntvrynbrnnhtgknyannrynbnnnnhtnacrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnndrdtbranhynnnnnnnnnnyv

SEQ ID NO: 620 - RNA, 340 nt, synthetic construct
  misc_feature 1..340: note = Description of Sequence: Synthetic polynucleotide
  variation 15..16: note = a, c, u, or g
  variation 24: note = a, c, u, or g
  variation 27: note = a, c, u, or g
  variation 29..30: note = a, c, u, or g
  variation 41..43: note = a, c, u, or g
  variation 45..315: note = a, c, u, or g
  misc_feature 45..315: note = This region may encompass 1-271 nucleotides
  variation 317..318: note = a, c, u, or g
  variation 326: note = a, c, u, or g
  variation 330: note = a, c, u, or g
  variation 333: note = a, c, u, or g
  variation 1..340: note = May or may not be present
  misc_feature 1..340: note = See specification as filed for detailed description of substitutions and preferred embodiments
  source 1..340: mol_type = other RNA
kbkbshdtrrydbrnnhgktyadnrynynndhythacrhknnnrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbnnrrdtbranhybndvndsdwvyv

SEQ ID NO: 621 - RNA, 340 nt, synthetic construct
  misc_feature 1..340: note = Description of Sequence: Synthetic polynucleotide
  variation 45..315: note = a, c, u, or g
  misc_feature 45..315: note = This region may encompass 1-271 nucleotides
  variation 317..318: note = a, c, u, or g
  variation 330: note = a, c, u, or g
  variation 1..340: note = May or may not be present
  misc_feature 1..340: note = See specification as filed for detailed description of substitutions and preferred embodiments
  source 1..340: mol_type = other RNA
kbkbsydtrgydbrbhtgktyadhryvyhhdyythacahkhddrnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnbnngrdtbradhyyndvhrsdwvya

SEQ ID NO: 622 - RNA, 76 nt, synthetic construct
  misc_feature 1..76: note = Description of Sequence: Synthetic oligonucleotide
  source 1..76: mol_type = other RNA
ggctccgtggcgcaatggatagcgcattggacttcaaattcaaaggttccgggttcgagtcccggcggagtcgcca

SEQ ID NO: 623 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 624 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 625 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 626 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 627 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 628 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 629 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 630 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 631 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 632 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 633 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 634 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 635 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 636 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 637 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 638 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 639 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 640 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 641 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 642 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 643 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 644 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 645 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 646 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 647 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 648 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 649 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 650 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 651 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 652 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 653 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 654 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 655 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 656 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 657 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 658 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 659 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 660 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 661 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 662 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 663 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 664 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 665 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 666 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 667 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 668 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 669 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 670 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 671 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 672 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 673 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 674 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 675 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 676 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 677 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 678 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 679 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 680 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 681 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 682 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 683 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 684 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 685 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 686 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 687 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 688 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 689 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 690 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 691 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 692 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 693 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 694 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 695 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 696 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 697 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 698 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 699 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 700 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 701 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 702 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 703 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 704 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 705 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 706 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 707 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 708 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 709 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 710 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 711 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 712 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 713 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 714 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 715 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 716 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 717 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 718 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 719 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 720 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 721 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 722 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 723 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 724 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 725 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 726 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 727 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 728 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 729 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 730 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 731 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 732 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 733 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 734 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 735 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 736 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 737 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 738 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 739 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 740 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 741 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 742 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 743 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 744 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 745 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 746 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 747 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 748 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 749 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 750 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 751 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 752 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 753 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 754 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 755 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 756 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 757 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 758 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 759 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 760 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 761 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 762 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 763 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 764 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 765 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 766 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 767 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 768 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 769 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 770 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 771 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 772 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 773 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 774 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 775 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 776 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 777 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 778 - DNA, 76 bp, synthetic construct
  misc_feature 1..76: note = Description of sequence: Synthetic oligonucleotide
  source 1..76: mol_type = other DNA
  misc_feature 1..76: note = DNA/RNA Hybrid Sequence
  modified_base 8: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..8: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA
ggctccgtggcgcaatggatagcgcattggacttcaaattcaaaggttccgggttcgagtcccggcggagtcgcca

SEQ ID NO: 779 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 780 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 781 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 782 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 783 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 784 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 785 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 786 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 787 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 788 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 789 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 790 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 791 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 792 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 793 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 794 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 795 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 796 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 797 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..27: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 798 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 28..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 799 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 800 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 801 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 802 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..33: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 803 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 34..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 804 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 805 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 806 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 807 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 808 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 809 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 810 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 811 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 812 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 813 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 814 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..47: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 815 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 48..53: note = Segment is DNA
  misc_feature 56..59: note = Segment is DNA
  misc_feature 61..70: note = Segment is DNA
  misc_feature 72..76: note = Segment is DNA

SEQ ID NO: 816 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 817 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 818 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 819 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 820 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 821 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..54: note = Segment is DNA
  misc_feature 56..59: note = Segment is DNA
  misc_feature 61..70: note = Segment is DNA
  misc_feature 72..76: note = Segment is DNA

SEQ ID NO: 822 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 55..59: note = Segment is DNA
  misc_feature 61..70: note = Segment is DNA
  misc_feature 72..76: note = Segment is DNA

SEQ ID NO: 823 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 824 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 825 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 826 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 827 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..70: note = Segment is DNA
  misc_feature 72..76: note = Segment is DNA

SEQ ID NO: 828 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 829 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 830 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 831 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 832 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 833 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 834 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 835 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 836 - DNA, 76 bp, synthetic construct; identical to SEQ ID NO: 778
  misc_feature 1..76: note = Description of sequence: Synthetic oligonucleotide
  source 1..76: mol_type = other DNA
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 60..76: note = Segment is DNA

SEQ ID NO: 837 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 838 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 839 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 840 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 841 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 842 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..4: note = Segment is DNA
  misc_feature 5..7: note = Segment is DNA
  misc_feature 9..15: note = Segment is DNA
  misc_feature 17..19: note = Segment is DNA
  misc_feature 21..26: note = Segment is DNA
  misc_feature 29..32: note = Segment is DNA
  misc_feature 35..38: note = Segment is DNA
  misc_feature 41..46: note = Segment is DNA
  misc_feature 49..53: note = Segment is DNA
  misc_feature 56..59: note = Segment is DNA
  misc_feature 61..70: note = Segment is DNA
  misc_feature 72..76: note = Segment is DNA

SEQ ID NO: 843 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 844 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 845 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 846 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 847 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 848 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 849 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 850 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 851 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 852 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 853 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 854 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 855 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 856 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 857 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 858 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 859 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 860 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 861 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 862 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 863 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 864 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 865 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 866 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 867 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 868 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 869 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 870 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 871 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 872 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 873 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 874 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 875 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 876 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 877 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 878 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 879 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 880 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 881 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 882 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 883 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 884 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 885 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 886 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 887 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 888 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 889 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 890 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 891 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 892 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 893 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 894 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 895 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 896 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 897 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 898 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 899 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 900 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 901 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 902 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 903 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 904 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 905 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 906 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 907 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 908 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 909 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 910 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 911 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 912 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 913 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 914 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 915 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 916 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 917 - DNA, 76 bp, synthetic construct; identical to SEQ ID NO: 778
  misc_feature 1..76: note = Description of sequence: Synthetic oligonucleotide
  source 1..76: mol_type = other DNA
  misc_feature 1..76: note = DNA/RNA Hybrid Sequence
  modified_base 4: mod_base = OTHER; note = t is uracil
  modified_base 8: mod_base = OTHER; note = t is uracil
  modified_base 16: mod_base = OTHER; note = t is uracil
  modified_base 20: mod_base = OTHER; note = t is uracil
  modified_base 27: mod_base = OTHER; note = t is uracil
  modified_base 28: mod_base = OTHER; note = t is uracil
  modified_base 33: mod_base = OTHER; note = t is uracil
  modified_base 34: mod_base = OTHER; note = t is uracil
  modified_base 39: mod_base = OTHER; note = t is uracil
  modified_base 40: mod_base = OTHER; note = t is uracil
  modified_base 47: mod_base = OTHER; note = t is uracil
  modified_base 48: mod_base = OTHER; note = t is uracil
  modified_base 54: mod_base = OTHER; note = t is uracil
  modified_base 55: mod_base = OTHER; note = t is uracil
  modified_base 60: mod_base = OTHER; note = t is uracil
  modified_base 71: mod_base = OTHER; note = t is uracil
  misc_feature 4: note = segment is RNA
  misc_feature 8: note = segment is RNA
  misc_feature 16: note = segment is RNA
  misc_feature 20: note = segment is RNA
  misc_feature 27: note = segment is RNA
  misc_feature 28: note = segment is RNA
  misc_feature 33: note = segment is RNA
  misc_feature 34: note = segment is RNA
  misc_feature 39: note = segment is RNA
  misc_feature 40: note = segment is RNA
  misc_feature 47: note = segment is RNA
  misc_feature 48: note = segment is RNA
  misc_feature 54: note = segment is RNA
  misc_feature 55: note = segment is RNA
  misc_feature 60: note = segment is RNA
  misc_feature 71: note = segment is RNA
  misc_feature 1..3: note = segment is DNA
  misc_feature 5..7: note = segment is DNA
  misc_feature 9..15: note = segment is DNA
  misc_feature 17..19: note = segment is DNA
  misc_feature 21..26: note = segment is DNA
  misc_feature 29..32: note = segment is DNA
  misc_feature 35..38: note = segment is DNA
  misc_feature 41..46: note = segment is DNA
  misc_feature 49..53: note = segment is DNA
  misc_feature 56..59: note = segment is DNA
  misc_feature 61..70: note = segment is DNA
  misc_feature 72..76: note = segment is DNA

SEQ ID NO: 918 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 919 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 920 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 921 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 922 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 923 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 924 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 925 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 926 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 927 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 928 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 929 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 930 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 931 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 932 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 933 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 934 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 935 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 936 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 937 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 938 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 939 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 940 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 941 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 942 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 943 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 944 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 945 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 946 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 947 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 948 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 949 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 950 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 951 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 952 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 953 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 954 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 955 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 956 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 957 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 958 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 959 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 960 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 961 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 962 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 963 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 964 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 965 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 966 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 967 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 968 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 969 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 970 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 971 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 972 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 973 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 974 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 975 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 976 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 977 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 978 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 979 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 980 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 981 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 982 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 983 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 984 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 985 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 986 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 987 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 988 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 989 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 990 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 991 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 992 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 993 - RNA, 85 nt, synthetic construct
  misc_feature 1..85: note = Description of Sequence: Synthetic oligonucleotide
  source 1..85: mol_type = other RNA
gacgaggtggccgagtggttaaggcgatggactctaaatccattgtgctctgcacgcgtgggttcgaatcccatcctcgtcgcca

SEQ ID NO: 994 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 995 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 996 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 997 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 998 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 999 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1000 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1001 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1002 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1003 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1004 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1005 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1006 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1007 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1008 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1009 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1010 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1011 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1012 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1013 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1014 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1015 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1016 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1017 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1018 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1019 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1020 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1021 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1022 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1023 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1024 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1025 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1026 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1027 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1028 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1029 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1030 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1031 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1032 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1033 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1034 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1035 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1036 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1037 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1038 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1039 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1040 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1041 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1042 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1043 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1044 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1045 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1046 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1047 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1048 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1049 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1050 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1051 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1052 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1053 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1054 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1055 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1056 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1057 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1058 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1059 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1060 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1061 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1062 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1063 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1064 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1065 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1066 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1067 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1068 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1069 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1070 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1071 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1072 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1073 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1074 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1075 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1076 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1077 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1078 - RNA, 85 nt, synthetic construct; identical to SEQ ID NO: 993
  misc_feature 1..85: note = Description of Sequence: Synthetic oligonucleotide
  source 1..85: mol_type = other RNA

SEQ ID NO: 1079 - RNA, 75 nt, synthetic construct
  misc_feature 1..75: note = Description of Sequence: Synthetic oligonucleotide
  source 1..75: mol_type = other RNA
ggttccatggtgtaatggtaagcactctggactttaaatccagcgatccgagttcgagtctcggtggaacctcca

SEQ ID NO: 1080 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1081 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1082 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1083 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1084 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1085 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1086 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1087 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1088 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1089 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1090 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1091 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1092 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1093 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1094 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1095 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1096 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1097 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1098 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1099 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1100 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1101 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1102 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1103 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1104 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1105 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1106 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1107 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1108 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1109 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1110 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1111 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1112 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1113 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1114 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1115 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1116 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1117 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1118 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1119 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1120 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1121 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1122 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1123 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1124 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1125 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1126 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1127 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1128 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1129 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1130 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1131 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1132 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1133 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1134 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1135 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1136 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1137 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1138 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1139 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1140 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1141 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1142 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1143 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1144 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1145 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1146 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1147 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1148 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1149 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1150 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1151 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1152 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1153 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1154 - RNA, 75 nt, synthetic construct; identical to SEQ ID NO: 1079
  misc_feature 1..75: note = Description of Sequence: Synthetic oligonucleotide
  source 1..75: mol_type = other RNA

SEQ ID NO: 1155 - RNA, 73 nt, synthetic construct
  misc_feature 1..73: note = Description of Sequence: Synthetic oligonucleotide
  source 1..73: mol_type = other RNA
ggctccgtggcgcaatggatagcgcattggacttcaaattcaaaggttccgggttcgagtcccggcggagtcg

SEQ ID NO: 1156 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1157 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1158 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1159 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1160 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1161 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1162 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1163 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1164 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1165 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1166 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1167 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1168 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1169 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1170 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1171 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1172 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1173 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1174 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1175 - RNA, 75 nt, synthetic construct
  misc_feature 1..75: note = Description of Sequence: Synthetic oligonucleotide
  source 1..75: mol_type = other RNA
ggctccgtggcgcaatggatagcgcattggacttcaaattcaaaggttccgggttcgagtcccggcggagtcgcc

SEQ ID NO: 1176 - RNA, 74 nt, synthetic construct
  misc_feature 1..74: note = Description of Sequence: Synthetic oligonucleotide
  source 1..74: mol_type = other RNA
ggctccgtggcgcaatggatagcgcattggacttcaaattcaaaggttccgggttcgagtcccggcggagtcgc

SEQ ID NO: 1177 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1178 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1179 - RNA, 74 nt, synthetic construct; identical to SEQ ID NO: 1176
  misc_feature 1..74: note = Description of Sequence: Synthetic oligonucleotide
  source 1..74: mol_type = other RNA

SEQ ID NO: 1180 - RNA, 75 nt, synthetic construct; identical to SEQ ID NO: 1175
  misc_feature 1..75: note = Description of Sequence: Synthetic oligonucleotide
  source 1..75: mol_type = other RNA

SEQ ID NO: 1181 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1182 - RNA, 76 nt, synthetic construct; identical to SEQ ID NO: 622
  misc_feature 1..76: note = Description of Sequence: Synthetic oligonucleotide
  source 1..76: mol_type = other RNA

SEQ ID NO: 1183 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1184 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1185 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1186 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1187 - RNA, 73 nt, synthetic construct; identical to SEQ ID NO: 1155
  misc_feature 1..73: note = Description of Sequence: Synthetic oligonucleotide
  source 1..73: mol_type = other RNA

SEQ ID NO: 1188-1199 - skipped (12 entries)

SEQ ID NO: 1200 - DNA, 73 bp, synthetic construct; identical to SEQ ID NO: 4
  misc_feature 1..73: note = Description of Sequence: Synthetic oligonucleotide
  source 1..73: mol_type = other DNA

SEQ ID NO: 1201 - DNA, 72 bp, synthetic construct; identical to SEQ ID NO: 17
  misc_feature 1..72: note = Description of Sequence: Synthetic oligonucleotide
  source 1..72: mol_type = other DNA

SEQ ID NO: 1202 - DNA, 72 bp, synthetic construct
  misc_feature 1..72: note = Description of Sequence: Synthetic oligonucleotide
  source 1..72: mol_type = other DNA
gggggtgtagctcagtggtagagcgcatgctttgcatgtatgaggccccgggttcgatccccggcacctcca

SEQ ID NO: 1203 - DNA, 73 bp, synthetic construct; identical to SEQ ID NO: 28
  misc_feature 1..73: note = Description of Sequence: Synthetic oligonucleotide
  source 1..73: mol_type = other DNA

SEQ ID NO: 1204 - DNA, 73 bp, synthetic construct; identical to SEQ ID NO: 30
  misc_feature 1..73: note = Description of Sequence: Synthetic oligonucleotide
  source 1..73: mol_type = other DNA

SEQ ID NO: 1205 - DNA, 73 bp, synthetic construct; identical to SEQ ID NO: 32
  misc_feature 1..73: note = Description of Sequence: Synthetic oligonucleotide
  source 1..73: mol_type = other DNA

SEQ ID NO: 1206 - DNA, 73 bp, synthetic construct
  misc_feature 1..73: note = Description of Sequence: Synthetic oligonucleotide
  source 1..73: mol_type = other DNA
gaccgcgtggcctaatggataaggcgtctgacttcggatcagaagattgagggttcgagtccctccgtggtcg

SEQ ID NO: 1207 - DNA, 74 bp, synthetic construct
  misc_feature 1..74: note = Description of Sequence: Synthetic oligonucleotide
  variation 21: note = a, c, t, g, unknown or other
  variation 65: note = a, c, t, g, unknown or other
  source 1..74: mol_type = other DNA
ggctctgtggcgcaatggatnagcgcattggacttctaattcaaaggttgcgggttcgagtcccnccagagtcg

SEQ ID NO: 1208 - DNA, 75 bp, synthetic construct
  misc_feature 1..75: note = Description of Sequence: Synthetic oligonucleotide
  variation 43: note = a, c, t, g, unknown or other
  source 1..75: mol_type = other DNA
gtctctgtggcgcaatcggttagcgcgttcggctgttaaccgnaaaggttggtggttcgagcccacccagggacg

SEQ ID NO: 1209 - DNA, 72 bp, synthetic construct; identical to SEQ ID NO: 62
  misc_feature 1..72: note = Description of Sequence: Synthetic oligonucleotide
  source 1..72: mol_type = other DNA

SEQ ID NO: 1210 - DNA, 73 bp, synthetic construct
  misc_feature 1..73: note = Description of Sequence: Synthetic oligonucleotide
  variation 16: note = a, c, t, g, unknown or other
  source 1..73: mol_type = other DNA
gggggtatagctcagngggtagagcatttgactgcagatcaagaggtccccggttcaaatccgggtgccccct

SEQ ID NO: 1211 - DNA, 72 bp, synthetic construct
  misc_feature 1..72: note = Description of Sequence: Synthetic oligonucleotide
  variation 20: note = a, c, t, g, unknown or other
  source 1..72: mol_type = other DNA
ggttccatggtgtaatggtnagcactctggactctgaatccagcgatccgagttcaagtctcggtggaacct

SEQ ID NO: 1212 - DNA, 72 bp, synthetic construct; identical to SEQ ID NO: 94
  misc_feature 1..72: note = Description of Sequence: Synthetic oligonucleotide
  source 1..72: mol_type = other DNA

SEQ ID NO: 1213 - DNA, 72 bp, synthetic construct; identical to SEQ ID NO: 98
  misc_feature 1..72: note = Description of Sequence: Synthetic oligonucleotide
  source 1..72: mol_type = other DNA

SEQ ID NO: 1214 - DNA, 72 bp, synthetic construct
  misc_feature 1..72: note = Description of Sequence: Synthetic oligonucleotide
  variation 42: note = a, c, t, g, unknown or other
  source 1..72: mol_type = other DNA
tccctggtggtctagtggctaggattcggcgctttcaccgcngcggcccgggttcgattcccggtcagggaa

SEQ ID NO: 1215 - DNA, 71 bp, synthetic construct
  misc_feature 1..71: note = Description of Sequence: Synthetic oligonucleotide
  variation 40: note = a, c, t, g, unknown or other
  source 1..71: mol_type = other DNA
gcattggtggttcagtggtagaattctcgcctcccacgcnggagacccgggttcgattcccggccaatgca

SEQ ID NO: 1216 - DNA, 71 bp, synthetic construct; identical to SEQ ID NO: 108
  misc_feature 1..71: note = Description of Sequence: Synthetic oligonucleotide
  source 1..71: mol_type = other DNA

SEQ ID NO: 1217 - DNA, 72 bp, synthetic construct; identical to SEQ ID NO: 113
  misc_feature 1..72: note = Description of Sequence: Synthetic oligonucleotide
  source 1..72: mol_type = other DNA

SEQ ID NO: 1218 - DNA, 74 bp, synthetic construct; identical to SEQ ID NO: 122
  misc_feature 1..74: note = Description of Sequence: Synthetic oligonucleotide
  source 1..74: mol_type = other DNA

SEQ ID NO: 1219 - DNA, 74 bp, synthetic construct
  misc_feature 1..74: note = Description of Sequence: Synthetic oligonucleotide
  source 1..74: mol_type = other DNA
gctccagtggcgcaatcggttagcgcgcggtacttataatgccgaggttgtgagttcgagcctcacctggagca

SEQ ID NO: 1220 - DNA, 82 bp, synthetic construct; identical to SEQ ID NO: 134
  misc_feature 1..82: note = Description of Sequence: Synthetic oligonucleotide
  source 1..82: mol_type = other DNA

SEQ ID NO: 1221 - DNA, 85 bp, synthetic construct
  misc_feature 1..85: note = Description of Sequence: Synthetic oligonucleotide
  variation 21: note = a, c, t, g, unknown or other
  variation 52: note = a, c, t, g, unknown or other
  source 1..85: mol_type = other DNA
gtcaggatggccgagtggtcntaaggcgccagactcaagttctggtctccgnatggaggcgtgggttcgaatcccacttctgaca

SEQ ID NO: 1222 - DNA, 83 bp, synthetic construct; identical to SEQ ID NO: 144
  misc_feature 1..83: note = Description of Sequence: Synthetic oligonucleotide
  source 1..83: mol_type = other DNA

SEQ ID NO: 1223 - DNA, 83 bp, synthetic construct
  misc_feature 1..83: note = Description of Sequence: Synthetic oligonucleotide
  source 1..83: mol_type = other DNA
accaggatggccgagtggttaaggcgttggacttaagatccaatggacagatgtccgcgtgggttcgaaccccactcctggta

SEQ ID NO: 1224 - DNA, 82 bp, synthetic construct
  misc_feature 1..82: note = Description of Sequence: Synthetic oligonucleotide
  variation 54: note = a, c, t, g, unknown or other
  source 1..82: mol_type = other DNA
ggtagcgtggccgagcggtctaaggcgctggatttaggctccagtctcttcggnggcgtgggttcgaatcccaccgctgcca

SEQ ID NO: 1225 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gcccggctagctcagtcggtagagcatgagactcttaatctcagggtcgtgggttcgagccccacgttgggcgnnn

SEQ ID NO: 1226 - DNA, 73 bp, synthetic construct; identical to SEQ ID NO: 167
  misc_feature 1..73: note = Description of Sequence: Synthetic oligonucleotide
  source 1..73: mol_type = other DNA

SEQ ID NO: 1227 - DNA, 73 bp, synthetic construct
  misc_feature 1..73: note = Description of Sequence: Synthetic oligonucleotide
  variation 17: note = a, c, t, g, unknown or other
  source 1..73: mol_type = other DNA
gccctcttagcgcagtnggcagcgcgtcagtctcataatctgaaggtcctgagttcgagcctcagagagggca

SEQ ID NO: 1228 - DNA, 74 bp, synthetic construct
  misc_feature 1..74: note = Description of Sequence: Synthetic oligonucleotide
  variation 41: note = a, c, t, g, unknown or other
  source 1..74: mol_type = other DNA
gccgaaatagctcagttgggagagcgttagactgaagatcntaaaggtccctggttcaatcccgggtttcggca

SEQ ID NO: 1229 - DNA, 72 bp, synthetic construct; identical to SEQ ID NO: 183
  misc_feature 1..72: note = Description of Sequence: Synthetic oligonucleotide
  source 1..72: mol_type = other DNA

SEQ ID NO: 1230 - DNA, 72 bp, synthetic construct; identical to SEQ ID NO: 185
  misc_feature 1..72: note = Description of Sequence: Synthetic oligonucleotide
  source 1..72: mol_type = other DNA

SEQ ID NO: 1231 - DNA, 72 bp, synthetic construct; identical to SEQ ID NO: 189
  misc_feature 1..72: note = Description of Sequence: Synthetic oligonucleotide
  source 1..72: mol_type = other DNA

SEQ ID NO: 1232 - DNA, 82 bp, synthetic construct; identical to SEQ ID NO: 192
  misc_feature 1..82: note = Description of Sequence: Synthetic oligonucleotide
  source 1..82: mol_type = other DNA

SEQ ID NO: 1233 - DNA, 82 bp, synthetic construct; identical to SEQ ID NO: 196
  misc_feature 1..82: note = Description of Sequence: Synthetic oligonucleotide
  source 1..82: mol_type = other DNA

SEQ ID NO: 1234 - DNA, 84 bp, synthetic construct
  misc_feature 1..84: note = Description of Sequence: Synthetic oligonucleotide
  variation 8..9: note = a, c, t, g, unknown or other
  source 1..84: mol_type = other DNA
gacgaggnntggccgagtggttaaggcgatggactgctaatccattgtgctctgcacgcgtgggttcgaatcccatcctcgtcg

SEQ ID NO: 1235 - DNA, 82 bp, synthetic construct
  misc_feature 1..82: note = Description of Sequence: Synthetic oligonucleotide
  source 1..82: mol_type = other DNA
gtagtcgtggccgagtggttaaggcgatggacttgaaatccattggggtctccccgcgcaggttcgaatcctgccggctacg

SEQ ID NO: 1236 - DNA, 74 bp, synthetic construct; identical to SEQ ID NO: 211
  misc_feature 1..74: note = Description of Sequence: Synthetic oligonucleotide
  source 1..74: mol_type = other DNA

SEQ ID NO: 1237 - DNA, 75 bp, synthetic construct
  misc_feature 1..75: note = Description of Sequence: Synthetic oligonucleotide
  variation 4: note = a, c, t, g, unknown or other
  variation 13: note = a, c, t, g, unknown or other
  variation 17: note = a, c, t, g, unknown or other
  variation 20: note = a, c, t, g, unknown or other
  variation 43: note = a, c, t, g, unknown or other
  variation 51: note = a, c, t, g, unknown or other
  variation 67: note = a, c, t, g, unknown or other
  variation 69: note = a, c, t, g, unknown or other
  source 1..75: mol_type = other DNA
ggcnctgtggctnagtnggntaaagcgccggtctcgtaaaccnggagatcntgggttcgaatcccancngggcct

SEQ ID NO: 1238 - DNA, 74 bp, synthetic construct
  misc_feature 1..74: note = Description of Sequence: Synthetic oligonucleotide
  variation 16: note = a, c, t, g, unknown or other
  source 1..74: mol_type = other DNA
ggctccatagctcagngggttagagcactggtcttgtaaaccaggggtcgcgagttcaaatctcgctggggcct

SEQ ID NO: 1239 - DNA, 72 bp, synthetic construct; identical to SEQ ID NO: 229
  misc_feature 1..72: note = Description of Sequence: Synthetic oligonucleotide
  source 1..72: mol_type = other DNA

SEQ ID NO: 1240 - DNA, 73 bp, synthetic construct
  misc_feature 1..73: note = Description of Sequence: Synthetic oligonucleotide
  source 1..73: mol_type = other DNA
ccttcgatagctcagctggtagagcggaggactgtagatccttaggtcgctggttcgattccggctcgaagga

SEQ ID NO: 1241 - DNA, 73 bp, synthetic construct; identical to SEQ ID NO: 246
  misc_feature 1..73: note = Description of Sequence: Synthetic oligonucleotide
  source 1..73: mol_type = other DNA

SEQ ID NO: 1242 - DNA, 73 bp, synthetic construct; identical to SEQ ID NO: 252
  misc_feature 1..73: note = Description of Sequence: Synthetic oligonucleotide
  source 1..73: mol_type = other DNA

SEQ ID NO: 1243 - DNA, 73 bp, synthetic construct; identical to SEQ ID NO: 258
  misc_feature 1..73: note = Description of Sequence: Synthetic oligonucleotide
  source 1..73: mol_type = other DNA

SEQ ID NO: 1244 - DNA, 72 bp, synthetic construct; identical to SEQ ID NO: 262
  misc_feature 1..72: note = Description of Sequence: Synthetic oligonucleotide
  source 1..72: mol_type = other DNA

SEQ ID NO: 1245 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
ggggaattagctcaagtggtagagcgcttgcttagcatgcaagaggtagtgggatcgatgcccacattctccannn

SEQ ID NO: 1246 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
ggggatgtagctcagtggtagagcgcatgcttcgcatgtatgaggtcccgggttcgatccccggcatctccannn

SEQ ID NO: 1247 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
gggggtgtagctcagtggtagagcgcatgctttgcatgtatgaggccccgggttcgatccccggcacctccannn

SEQ ID NO: 1248 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gggccagtggcgcaatggataacgcgtctgactacggatcagaagattccaggttcgactcctggctggctcgnnn

SEQ ID NO: 1249 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
ggccgcgtggcctaatggataaggcgtctgattccggatcagaagattgagggttcgagtcccttcgtggtcgnnn

SEQ ID NO: 1250 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gccccagtggcctaatggataaggcactggcctcctaagccagggattgtgggttcgagtcccacctggggtannn

SEQ ID NO: 1251 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gaccgcgtggcctaatggataaggcgtctgacttcggatcagaagattgagggttcgagtccctccgtggtcgnnn

SEQ ID NO: 1252 - DNA, 77 bp, synthetic construct
  misc_feature 1..77: note = Description of Sequence: Synthetic oligonucleotide
  variation 21: note = a, c, t, g, unknown or other
  variation 65: note = a, c, t, g, unknown or other
  variation 75..77: note = a, c, t, g, unknown or other
  source 1..77: mol_type = other DNA
ggctctgtggcgcaatggatnagcgcattggacttctaattcaaaggttgcgggttcgagtcccnccagagtcgnnn

SEQ ID NO: 1253 - DNA, 78 bp, synthetic construct
  misc_feature 1..78: note = Description of Sequence: Synthetic oligonucleotide
  variation 43: note = a, c, t, g, unknown or other
  variation 76..78: note = a, c, t, g, unknown or other
  source 1..78: mol_type = other DNA
gtctctgtggcgcaatcggttagcgcgttcggctgttaaccgnaaaggttggtggttcgagcccacccagggacgnnn

SEQ ID NO: 1254 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
tcctcgttagtatagtggtgagtatccccgcctgtcacgcgggagaccggggttcgattccccgacggggagnnn

SEQ ID NO: 1255 - DNA, 76 bp, synthetic construct
  misc_feature 1..76: note = Description of Sequence: Synthetic oligonucleotide
  variation 16: note = a, c, t, g, unknown or other
  variation 74..76: note = a, c, t, g, unknown or other
  source 1..76: mol_type = other DNA
gggggtatagctcagngggtagagcatttgactgcagatcaagaggtccccggttcaaatccgggtgccccctnnn

SEQ ID NO: 1256 - DNA, 75 bp, synthetic construct
  misc_feature 1..75: note = Description of Sequence: Synthetic oligonucleotide
  variation 20: note = a, c, t, g, unknown or other
  variation 73..75: note = a, c, t, g, unknown or other
  source 1..75: mol_type = other DNA
ggttccatggtgtaatggtnagcactctggactctgaatccagcgatccgagttcaagtctcggtggaacctnnn

SEQ ID NO: 1257 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
ggtcccatggtgtaatggttagcactctggactttgaatccagcgatccgagttcaaatctcggtgggacctnnn

SEQ ID NO: 1258 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
tccctggtggtctagtggttaggattcggcgctctcaccgccgcggcccgggttcgattcccggtcagggaannn

SEQ ID NO: 1259 - DNA, 75 bp, synthetic construct
  misc_feature 1..75: note = Description of Sequence: Synthetic oligonucleotide
  variation 42: note = a, c, t, g, unknown or other
  variation 73..75: note = a, c, t, g, unknown or other
  source 1..75: mol_type = other DNA
tccctggtggtctagtggctaggattcggcgctttcaccgcngcggcccgggttcgattcccggtcagggaannn

SEQ ID NO: 1260 - DNA, 74 bp, synthetic construct
  misc_feature 1..74: note = Description of Sequence: Synthetic oligonucleotide
  variation 40: note = a, c, t, g, unknown or other
  variation 72..74: note = a, c, t, g, unknown or other
  source 1..74: mol_type = other DNA
gcattggtggttcagtggtagaattctcgcctcccacgcnggagacccgggttcgattcccggccaatgcannn

SEQ ID NO: 1261 - DNA, 74 bp, synthetic construct
  misc_feature 1..74: note = Description of Sequence: Synthetic oligonucleotide
  variation 72..74: note = a, c, t, g, unknown or other
  source 1..74: mol_type = other DNA
gcattggtggttcagtggtagaattctcgcctgccacgcgggaggcccgggttcgattcccggccaatgcannn

SEQ ID NO: 1262 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
gcgttggtggtatagtggtgagcatagctgccttccaagcagttgacccgggttcgattcccggccaacgcannn

SEQ ID NO: 1263 - DNA, 77 bp, synthetic construct
  misc_feature 1..77: note = Description of Sequence: Synthetic oligonucleotide
  variation 75..77: note = a, c, t, g, unknown or other
  source 1..77: mol_type = other DNA
ggccggttagctcagttggttagagcgtggtgctaataacgccaaggtcgcgggttcgatccccgtacgggccannn

SEQ ID NO: 1264 - DNA, 77 bp, synthetic construct
  misc_feature 1..77: note = Description of Sequence: Synthetic oligonucleotide
  variation 75..77: note = a, c, t, g, unknown or other
  source 1..77: mol_type = other DNA
gctccagtggcgcaatcggttagcgcgcggtacttataatgccgaggttgtgagttcgagcctcacctggagcannn

SEQ ID NO: 1265 - DNA, 85 bp, synthetic construct
  misc_feature 1..85: note = Description of Sequence: Synthetic oligonucleotide
  variation 83..85: note = a, c, t, g, unknown or other
  source 1..85: mol_type = other DNA
ggtagcgtggccgagcggtctaaggcgctggattaaggctccagtctcttcgggggcgtgggttcgaatcccaccgctgccannn

SEQ ID NO: 1266 - DNA, 88 bp, synthetic construct
  misc_feature 1..88: note = Description of Sequence: Synthetic oligonucleotide
  variation 21: note = a, c, t, g, unknown or other
  variation 52: note = a, c, t, g, unknown or other
  variation 86..88: note = a, c, t, g, unknown or other
  source 1..88: mol_type = other DNA
gtcaggatggccgagtggtcntaaggcgccagactcaagttctggtctccgnatggaggcgtgggttcgaatcccacttctgacannn

SEQ ID NO: 1267 - DNA, 86 bp, synthetic construct
  misc_feature 1..86: note = Description of Sequence: Synthetic oligonucleotide
  variation 84..86: note = a, c, t, g, unknown or other
  source 1..86: mol_type = other DNA
gtcaggatggccgagcggtctaaggcgctgcgttcaggtcgcagtctcccctggaggcgtgggttcgaatcccactcctgacannn

SEQ ID NO: 1268 - DNA, 86 bp, synthetic construct
  misc_feature 1..86: note = Description of Sequence: Synthetic oligonucleotide
  variation 84..86: note = a, c, t, g, unknown or other
  source 1..86: mol_type = other DNA
accaggatggccgagtggttaaggcgttggacttaagatccaatggacagatgtccgcgtgggttcgaaccccactcctggtannn

SEQ ID NO: 1269 - DNA, 85 bp, synthetic construct
  misc_feature 1..85: note = Description of Sequence: Synthetic oligonucleotide
  variation 54: note = a, c, t, g, unknown or other
  variation 83..85: note = a, c, t, g, unknown or other
  source 1..85: mol_type = other DNA
ggtagcgtggccgagcggtctaaggcgctggatttaggctccagtctcttcggnggcgtgggttcgaatcccaccgctgccannn

SEQ ID NO: 1270 - DNA, 79 bp, synthetic construct
  misc_feature 1..79: note = Description of Sequence: Synthetic oligonucleotide
  variation 74..79: note = a, c, t, g, unknown or other
  source 1..79: mol_type = other DNA
gcccggctagctcagtcggtagagcatgagactcttaatctcagggtcgtgggttcgagccccacgttgggcgnnnnnn

SEQ ID NO: 1271 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gcctggatagctcagtcggtagagcatcagacttttaatctgagggtccagggttcaagtccctgttcaggcgnnn

SEQ ID NO: 1272 - DNA, 76 bp, synthetic construct
  misc_feature 1..76: note = Description of Sequence: Synthetic oligonucleotide
  variation 17: note = a, c, t, g, unknown or other
  variation 74..76: note = a, c, t, g, unknown or other
  source 1..76: mol_type = other DNA
gccctcttagcgcagtnggcagcgcgtcagtctcataatctgaaggtcctgagttcgagcctcagagagggcannn

SEQ ID NO: 1273 - DNA, 77 bp, synthetic construct
  misc_feature 1..77: note = Description of Sequence: Synthetic oligonucleotide
  variation 41: note = a, c, t, g, unknown or other
  variation 75..77: note = a, c, t, g, unknown or other
  source 1..77: mol_type = other DNA
gccgaaatagctcagttgggagagcgttagactgaagatcntaaaggtccctggttcaatcccgggtttcggcannn

SEQ ID NO: 1274 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
ggctcgttggtctaggggtatgattctcgcttaggatgcgagaggtcccgggttcaaatcccggacgagcccnnn

SEQ ID NO: 1275 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
ggctcgttggtctaggggtatgattctcgcttcgggtgcgagaggtcccgggttcaaatcccggacgagcccnnn

SEQ ID NO: 1276 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
ggctcgttggtctaggggtatgattctcgctttgggtgcgagaggtcccgggttcaaatcccggacgagcccnnn

SEQ ID NO: 1277 - DNA, 85 bp, synthetic construct
  misc_feature 1..85: note = Description of Sequence: Synthetic oligonucleotide
  variation 83..85: note = a, c, t, g, unknown or other
  source 1..85: mol_type = other DNA
gtagtcgtggccgagtggttaaggcgatggactagaaatccattggggtttccccgcgcaggttcgaatcctgccgactacgnnn

SEQ ID NO: 1278 - DNA, 85 bp, synthetic construct
  misc_feature 1..85: note = Description of Sequence: Synthetic oligonucleotide
  variation 83..85: note = a, c, t, g, unknown or other
  source 1..85: mol_type = other DNA
gctgtgatggccgagtggttaaggcgttggactcgaaatccaatggggtctccccgcgcaggttcgaatcctgctcacagcgnnn

SEQ ID NO: 1279 - DNA, 87 bp, synthetic construct
  misc_feature 1..87: note = Description of Sequence: Synthetic oligonucleotide
  variation 8..9: note = a, c, t, g, unknown or other
  variation 85..87: note = a, c, t, g, unknown or other
  source 1..87: mol_type = other DNA
gacgaggnntggccgagtggttaaggcgatggactgctaatccattgtgctctgcacgcgtgggttcgaatcccatcctcgtcgnnn

SEQ ID NO: 1280 - DNA, 85 bp, synthetic construct
  misc_feature 1..85: note = Description of Sequence: Synthetic oligonucleotide
  variation 83..85: note = a, c, t, g, unknown or other
  source 1..85: mol_type = other DNA
gtagtcgtggccgagtggttaaggcgatggacttgaaatccattggggtctccccgcgcaggttcgaatcctgccggctacgnnn

SEQ ID NO: 1281 - DNA, 77 bp, synthetic construct
  misc_feature 1..77: note = Description of Sequence: Synthetic oligonucleotide
  variation 75..77: note = a, c, t, g, unknown or other
  source 1..77: mol_type = other DNA
ggctccgtggcttagctggttaaagcgcctgtctagtaaacaggagatcctgggttcgaatcccagcggggcctnnn

SEQ ID NO: 1282 - DNA, 78 bp, synthetic construct
  misc_feature 1..78: note = Description of Sequence: Synthetic oligonucleotide
  variation 4: note = a, c, t, g, unknown or other
  variation 13: note = a, c, t, g, unknown or other
  variation 17: note = a, c, t, g, unknown or other
  variation 20: note = a, c, t, g, unknown or other
  variation 43: note = a, c, t, g, unknown or other
  variation 51: note = a, c, t, g, unknown or other
  variation 67: note = a, c, t, g, unknown or other
  variation 69: note = a, c, t, g, unknown or other
  variation 76..78: note = a, c, t, g, unknown or other
  source 1..78: mol_type = other DNA
ggcnctgtggctnagtnggntaaagcgccggtctcgtaaaccnggagatcntgggttcgaatcccancngggcctnnn

SEQ ID NO: 1283 - DNA, 77 bp, synthetic construct
  misc_feature 1..77: note = Description of Sequence: Synthetic oligonucleotide
  variation 16: note = a, c, t, g, unknown or other
  variation 75..77: note = a, c, t, g, unknown or other
  source 1..77: mol_type = other DNA
ggctccatagctcagngggttagagcactggtcttgtaaaccaggggtcgcgagttcaaatctcgctggggcctnnn

SEQ ID NO: 1284 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
gacctcgtggcgcaacggtagcgcgtctgactccagatcagaaggttgcgtgttcaaatcacgtcggggtcannn

SEQ ID NO: 1285 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
ccttcgatagctcagctggtagagcggaggactgtagatccttaggtcgctggttcgattccggctcgaaggannn

SEQ ID NO: 1286 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gtttccgtagtgtagtggttatcacgttcgcctaacacgcgaaaggtccccggttcgaaaccgggcggaaacannn

SEQ ID NO: 1287 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
gtttccgtagtgtagtggttatcacgttcgcctcacacgcgaaaggtccccggttcgaaaccgggcggaaacannn

SEQ ID NO: 1288 - DNA, 76 bp, synthetic construct
  misc_feature 1..76: note = Description of Sequence: Synthetic oligonucleotide
  variation 74..76: note = a, c, t, g, unknown or other
  source 1..76: mol_type = other DNA
ggttccatagtgtagtggttatcacgtctgctttacacgcagaaggtcctgggttcgagccccagtggaaccannn

SEQ ID NO: 1289 - DNA, 75 bp, synthetic construct
  misc_feature 1..75: note = Description of Sequence: Synthetic oligonucleotide
  variation 73..75: note = a, c, t, g, unknown or other
  source 1..75: mol_type = other DNA
agcagagtggcgcagcggaagcgtgctgggcccataacccagaggtcgatggatcgaaaccatcctctgctannn

SEQ ID NO: 1290 - RNA, 73 nt, synthetic construct
  misc_feature 1..73: note = Description of Sequence: Synthetic oligonucleotide
  source 1..73: mol_type = other RNA
ggctccgtggcgcaatggatagcgcattggacttctaattcaaaggttccgggttcgagtcccggcggagtcg

SEQ ID NO: 1291 - RNA, 75 nt, synthetic construct
  modified_base 13: mod_base = p
  misc_feature 1..75: note = Description of Sequence: Synthetic oligonucleotide
  misc_feature 1..75: note = Description of Combined DNA/RNA Molecule: Synthetic oligonucleotide
  source 1..75: mol_type = other RNA
ggttccatggtgnaatggtaagcactctggactctgaatccagcgatccgagttcgagtctcggtggaacctcca

SEQ ID NO: 1292 - RNA, 72 nt, synthetic construct
  misc_feature 1..72: note = Description of Sequence: Synthetic oligonucleotide
  source 1..72: mol_type = other RNA
ggctcgttggtctaggggtatgattctcgcttagggtgcgagaggtcccgggttcaaatcccggacgagccc

SEQ ID NO: 1293 - DNA, 72 bp, synthetic construct; identical to SEQ ID NO: 22
  misc_feature 1..72: note = Description of sequence: Synthetic oligonucleotide
  source 1..72: mol_type = other DNA
  misc_feature 1..72: note = DNA/RNA Hybrid Sequence
  modified_base 6: mod_base = OTHER; note = t is uracil
  modified_base 8: mod_base = OTHER; note = t is uracil
  modified_base 12: mod_base = OTHER; note = t is uracil
  modified_base 16: mod_base = OTHER; note = t is uracil
  modified_base 19: mod_base = OTHER; note = t is uracil
  modified_base 28: mod_base = OTHER; note = t is uracil
  modified_base 31: mod_base = OTHER; note = t is uracil
  modified_base 32: mod_base = OTHER; note = t is uracil
  modified_base 33: mod_base = OTHER; note = t is uracil
  modified_base 37: mod_base = OTHER; note = t is uracil
  modified_base 39: mod_base = OTHER; note = t is uracil
  modified_base 41: mod_base = OTHER; note = t is uracil
  modified_base 46: mod_base = OTHER; note = t is uracil
  modified_base 53: mod_base = OTHER; note = t is uracil
  modified_base 54: mod_base = OTHER; note = t is uracil
  modified_base 58: mod_base = OTHER; note = t is uracil
  modified_base 67: mod_base = OTHER; note = t is uracil
  modified_base 69: mod_base = OTHER; note = t is uracil
  misc_feature 6: note = segment is RNA
  misc_feature 8: note = segment is RNA
  misc_feature 12: note = segment is RNA
  misc_feature 16: note = segment is RNA
  misc_feature 19: note = segment is RNA
  misc_feature 28: note = segment is RNA
  misc_feature 31: note = segment is RNA
  misc_feature 32: note = segment is RNA
  misc_feature 33: note = segment is RNA
  misc_feature 37: note = segment is RNA
  misc_feature 39: note = segment is RNA
  misc_feature 41: note = segment is RNA
  misc_feature 46: note = segment is RNA
  misc_feature 53: note = segment is RNA
  misc_feature 54: note = segment is RNA
  misc_feature 58: note = segment is RNA
  misc_feature 67: note = segment is RNA
  misc_feature 69: note = segment is RNA
  misc_feature 1..5: note = Segment is DNA
  misc_feature 7: note = Position is DNA
  misc_feature 9..11: note = Segment is DNA
  misc_feature 13..15: note = Segment is DNA
  misc_feature 17..18: note = Segment is DNA
  misc_feature 20..27: note = Segment is DNA
  misc_feature 29..30: note = Segment is DNA
  misc_feature 34..36: note = Segment is DNA
  misc_feature 38: note = Position is DNA
  misc_feature 40: note = Position is DNA
  misc_feature 42..45: note = Segment is DNA
  misc_feature 47..52: note = Segment is DNA
  misc_feature 55..57: note = Segment is DNA
  misc_feature 59..66: note = Segment is DNA
  misc_feature 68: note = Position is DNA
  misc_feature 70..72: note = Segment is DNA

---

What is claimed is:

1. A tRNA-based effector molecule (TREM) comprising a non-naturally occurring modification at a nucleotide position corresponding to a selected nucleotide position of a reference sequence, wherein:

(i) the reference sequence is SEQ ID NO: 622, and the selected nucleotide position is selected from nucleotide positions 2, 3, and 73 of SEQ ID NO: 622;

(ii) the non-naturally occurring modification is selected from an internucleotide modification and a 2'-modification on a nucleotide sugar moiety;

(iii) the TREM comprises at least 73 nucleotides; and (iv) the TREM is capable of mediating acceptance of an amino acid or transfer of the amino acid in the initiation or elongation of a polypeptide chain.

2. The TREM of claim 1, wherein the selected nucleotide position of the reference sequence is nucleotide position 2.

3. The TREM of claim 1, wherein the selected nucleotide position of the reference sequence is nucleotide position 3.

4. The TREM of claim 1, wherein the selected nucleotide position of the reference sequence is nucleotide position 73.

5. The TREM of claim 1, further comprising a non-naturally occurring modification at nucleotide position corresponding to nucleotide position 16 or nucleotide position 52 of the reference sequence.

6. The TREM of claim 1, wherein the TREM comprises an anticodon domain comprising a non-naturally occurring modification.

7. The TREM of claim 1, wherein the TREM comprises an anticodon domain that does not comprise a non-naturally occurring modification.

8. The TREM of claim 1, wherein the non-naturally occurring modification is selected from 2'-OMe, 2'-F, 2'-deoxy, 2'-MOE, and a phosphorothioate internucleotide modification.

9. The TREM of claim 8, wherein the non-naturally occurring modification is a 2'-OMe modification.

10. The TREM of claim 8, wherein the non-naturally occurring modification is a 2'-F modification.

11. The TREM of claim 8, wherein the non-naturally occurring modification is a 2'-deoxy modification.

12. The TREM of claim 8, wherein the non-naturally occurring modification is a 2'-MOE modification.

13. The TREM of claim 8, wherein the non-naturally occurring modification is a phosphorothioate internucleotide modification.

14. The TREM of claim 1, wherein the TREM is formulated as a lipid nanoparticle.

* * * * *